United States Patent 10,590,436 (CRISPR-CAS SYSTEM FOR A LIPOLYTIC YEAST HOST CELL) - sequence listing, part 10

SEQ ID NO: 4 - DNA, 20550897 bp, Yarrowia lipolytica CLIB122 (residues 18,495,811-20,550,897 of 20,550,897)
  misc_feature (805062)..(805161): n is a, c, g, or t
  misc_feature (1509648)..(1509747): n is a, c, g, or t
  misc_feature (1510607)..(1510607): n is a, c, g, or t
  misc_feature (1510615)..(1510615): n is a, c, g, or t
  misc_feature (1510620)..(1510620): n is a, c, g, or t
  misc_feature (1510625)..(1510626): n is a, c, g, or t
  misc_feature (1510628)..(1510633): n is a, c, g, or t
  misc_feature (1510638)..(1510640): n is a, c, g, or t
  misc_feature (1969952)..(1970051): n is a, c, g, or t
  misc_feature (1993008)..(1993107): n is a, c, g, or t
  misc_feature (1993730)..(1993730): n is a, c, g, or t
  misc_feature (1993732)..(1993733): n is a, c, g, or t
  misc_feature (1993755)..(1993756): n is a, c, g, or t
  misc_feature (1993795)..(1993796): n is a, c, g, or t
  misc_feature (7074860)..(7074860): n is a, c, g, or t
  misc_feature (10088936)..(10088936): n is a, c, g, or t
  misc_feature (10711579)..(10711678): n is a, c, g, or t
  misc_feature (10711830)..(10711873): n is a, c, g, or t
  misc_feature (10755124)..(10755124): n is a, c, g, or t
  misc_feature (10755133)..(10755133): n is a, c, g, or t
  misc_feature (11338680)..(11338779): n is a, c, g, or t
  misc_feature (12388623)..(12388722): n is a, c, g, or t
  misc_feature (12655330)..(12655429): n is a, c, g, or t
  misc_feature (14664490)..(14664589): n is a, c, g, or t
  misc_feature (15198478)..(15198577): n is a, c, g, or t
  misc_feature (18230124)..(18230223): n is a, c, g, or t
  misc_feature (18756577)..(18756577): n is a, c, g, or t
  misc_feature (18756579)..(18756579): n is a, c, g, or t
tcctactctgctgctgctgatttcccgagccattgagaagttcgagagccaccagcgaggtgagactgcccgacaggtgcgagatcagtacgccaccgaatactctctcggtgactctctcatttcttcccccgagaagtttgctgctttccttgagaagctctaccccaagctacaactgcactttgactggttccgcaccacccagaagggagaggtcaaggagtgggaccgagaggccttttccaagcgagagggataccgatggagaggtcgaactaagacccactgtctgacttcgggcctagatgactaccctcgagctgagactccccatgctggtgagctccacgtcgaccttctctcttggatcggtcttatggcccgatctctcaaggatgtcgcccaattcctggataagcctgctgatgtgaagaagtacgccaaaattgagaatgccattgtccaaaaccttgacgaccttcactggagtgaagatgagcaggcctactgtgacgccaccattgacgactacgaggagaacgcccacgtgtgccacaagggctacgtttctctgtctcccttcttcctcaagcatattaaccccaagtccgagaagctccctgctgttcttgatctgatctcggatcccaacgagctttggagtgactacggactgcgatccttgtccaaatcctctcccttgttcggtaccaatgagaactactggcgagggcctatctggatgaacatcaactatcttgttcttgatgcactgaagcactacggagagaaccctgaggttgatcctaaggtgcgaaagcaggctgccgacatctactacaaactgcgacagaacaccgttaagaacgtccacaagcagtggaagaagactggctacggctgggagcagtacaacgaggagaccggtgctgcccagggagtgaagcattttactggatggacttctctggttgtcagcattatgggtatgcccgagaagttggatgtctgactaaatagcacattgaacgaggagttgtgaagagcagatgaataaatatatatatagaatacatgatacattaaatgaatgggatatcccgagatcttgtagacagtgtatcttttgctgttgctgtgagaggtagctactgtggccctgaacagggagatctcacaatacgagaggaaatagcaacaccggtgttattttggtgccgatgtaagcctttgtcacatacaaacttggtgtcaaatcaggtggtgcgctagtgcagatatacgaggctcgacgagaattctttcacatcaccggtactttgctcttttcaagtcaccaaagctcatcgacgcaatactaccaataccaacacccagactcgatcatacagttgcacaaggacaaacatagctattcaacaactgtttacaaaccagcagcaacatctatctggaacaattgagcaacctggataacaaacaacacatcataacagttctcatactcgacaacagtttgtgcaacaggttcgacaacacaaccacaagacgatccactccaaggctaacactggtttaatcatttgtgggtgtataacacagacgtagacacagacgcagacacagacacagtttcttcttttttttctttctcacagtttgtttactccacttggggtctgattaataatatattacaagatgtcttttactgtctgtgtatgaataagcgacacagatatataaaaatacacactcgattggcttctggatcgtcgtttaatccaggatggccgaaacgtgatgttgtgtgcttccgttgtaggcagcaaactgggcaaagatgatgagatcttcgacgattgttccaagggaaccaatgagccagggcatgtacttgacaacgtagtcccactcggtagagaagagtaggatgtagccggcataggtgaggttaccaaggagcgagaagatgaagaacagcagagagagaccctcgacggactttcgtcgggtgtttcggatgatctgggggattcgggccagcagatagagagcggcagacaggtatcctagaatctcggcaccaacgggcataggggggtcttcggcagggggctctccgctgtcgttggagaggaagtagccgacagttccggcagcaaagaccagaaccacggggacaccgtatcggacccatcggctctcggtggaggtgttctcgacgatgggttgcagaacggcatcgctaccccgtcggttaagcagaggctcggtctcgttctcgttctccgctggtggtgggggcttgtagtaggtgtaatagacgtaggaggcaatgatcaagccgtcggcgaagcagaaccataccgccaggaagaccacattggatcgcaaacccgcccacagggctcctgcgaggttggtgatatctcccaccagccagacaagaataaatccaatcgcaatgccttcagcggactgcaggcgccattgctcgatgagttggggcagaaggacaacgatccagcatgccagcgacgtggagccgcagattccggccagttgtgttcgtagagtcgacatatcgtcctgttggagcggtggtgaagtcaactgcgagacgagcaacaccaaaagataaccttataacccaagtatgaaaacgggagatgatgccggttggagtcactacgcagggatacggtgattacaccaggtatgtaaggggggtagttcaagtagagaccaaaaaccaaacttcactgggtgaaccgcgatcctctttagccaccaaactgcattccaaatctcgataagagggtacacttttgttgtatgctcaatctacaaaaccttacagtttgtgaaaatgttttcaatagcatacagagttcgacagatgaccagaagaacggttttgcgagaatgtaatggatcgttgaagcgtggttttgccacgtgacttagttccaccatttccgaaaaacatatataatcaccgtacgtgattgttcagtttatatccgcccatgtacacaggtacttgtacgtttttctccttcaccgcatctccccttgtgtccttgtgtggtgatttgactcctgtcgccgcggtagtataaaaaaccggaagactctcaactccctatattgtggagctatagtaagcataaaacgctctcagatagccgaaaaagcatgtctcagactgtatatagacttatggcctctcagaatcgaaatatatctcgggtcaggctttgtgaggagggggggacacctcgggtaatacaaattcaaatccacacaaagttccggggtgacagttacatacctacattggaagggtatatatgagatggaggggcaattttcgagtgtcaggtggtaaattgtcgacttatttgtgtccaaaagctcctcaaaaggcactatccgaccaaacaccgcgttctgaggcaatttggccgtgagtcgttatctgaaaagaaggttgatggggatgaccgaccttaccttgttgggagcgcaaaaaataaataaaaataaataattttttaatgagagaggaaaaggggaaggtttttttcatcggtgatttcagtatcggaaggattatatttatgtggttgtattttctgactctcatcagctctgtgtctgtgcctgtgcctgtgcctgtgtttttcgcggtccattactgcggtttagaatccacgtgaccacaaccttgaaccagcaagcgatgcacttagatacacctaaattaattggacatgcacacctcatcatggacaccgacaccgggtgcatatttgaagtaatgaaatgaaaagtctctataaagtcgaataaattacaaacaattgggaaggagcgataaatggcatttggatcggtgaaaaaccgtagacgcacttctgtacggcggttaatgacttcaattgttgggttacggctcaagcgcagcctgatggacttgtccttgtactttctaacagagacagggggacatgagagcgaagaagagctaggagaagttgatgggctagactataagcacacaagctcagctggagataatatcatatatacgaacaggtgcttgtacttgtactggtacaagtatgtagtgagtgcaacacatgaagctggtgagtcctagaaagtgctggagagtggatatgatgagcaacaatgacagttcagaaacatagcgacttatatttcgtgttgtttacttggcagtatcttggcaggagacgggaagttcaagacgactcgacctttactccccaaatgtaacttgtaccgatggataacaaaggaggcgcttgactaatatgatggcttctattgtcacatgagtagcggggaatctcaaagcgacttttattccttttctatgagtataatctcttgaggttcgactttatgagtttgcgatcagtgatgtactctttccagcagaagtcggagctgagatttgtgaccgatgtggaaggtgagagagatcgagatcaagatcgcgatcaaagtcaacaaccaagcagattgtgaatcctgtctcattcttgcaaattcccttttacaatattaaatgtgtttgttgtatgtatatagcgtacagctatggctctaacatgttgtctcaagcatgagcaaagacaagaggggacgagcagagatgataaaattatagatgtgctaataatttccgcttgaagagaatactcccgctcccaaacaagaatccccggtcggtcagaactatagcggtatcgatgtaacatggcttccggaaagcctgtcatagctcatatatattgttagcaggactggaagtggcgcataaaaaggtatcagctggtagtttagtctactctgtgcgtatggaatactgtgcgtatggaatactatgctctgcacatcttccaagagctctgtgtgctaatgattgtatctcaatcgggtattgccgaggattgcgctgtatttggaatagacccatacgggaaatcaacattaataactcctccttctcttagtatcacacacaaacacacacattcctctagaagatctgttatatcatctaaccactgcttaaccccggtcttttgttcggtgttactggaagggaactcatgtggggaaggggccaatctattatttaggagacaataaaatgtggagagacttgccttccttttattcccggtactaattcaagtagactgcaataaatccttttgtttgtgtggatttatttatatatttatggataatttttttttactgggtcaatttagcatttccaaagtaggtatttgagagacccttatacaaatgcttgtaaaagtgcaacgagagttgtgtttgtcgaagatggggatcataggcactaatttggcgcccaatattacaaaggtctctgtacttgtgtaacgaacacccgacccaagttgagaaacccgaaagcagtttcttctgcatctgtttttatctcaactgttcacaggagctattgaatatcctctgaaagtcctcagaagcatttgcgaagctgaacagtgatcatgaagtctacatatcaaatatttttcttgaagaagagaggatcccagggacacagtcatggtgctggagtcactttactgctgttagctttaaagatgttcttttatgacgaagccggagcagccaaaatctgccaatacaagttctggtatagtacatacgtagttgcatttatgttcatgtcagttgacagtgacagacttgaactgtgctcgtctcggacttaacaagtacaattatgttgtactgaccaaccatataatccggaaccgaaggatatccacagcggctgtttcatctcttcatatagcaacggtatcgagtttgtatctaacggatggataaccgttgttttgtttttctgcacatctgattcaattggagtcagatactgtgccagtggtgaattatttgctttgcctgttctattattggcacggttgtgaaacctgaaacaccgcataaacatagtagcagttattcgtttgaaaatcataataaataggaagtgtcgatagtcaataagcagtgataacgcgacatcggaggactatgttattggtgttgtagggaacatgatcctcgtaaaagacttcttattgctggcacgaagtttagttcgggaagttgagaaggtctccaacaatcgcatactgtagtcctggctagatcaaacccgcattcttctattgtttttcttccattttttcttccattaagtgcctgttttggaagaaaaagaaaagtaagggtactcggagacagccaagcaaaagcaacgactatgagagattcaacatgcgcctccatgtacaacacgcatagtgcatgatacactacagggaaacggcaaaaagctataactttcagattatggcgatttgcaaaagcaaccaccgtcccaattggtcaagcaccgtccattttgagccataattgacatggctgcttgagatccgatgcaaatttcccctggctggctatttctcattgaatacaagcacatatcacttggatgcacagtagaacatgctctaatgagacagtctcacccatacgactctggtcttggtccggtaattagatgtaaccctgcggctattacttgtcctgtacaagtgtgtacgtacagttacaaatgtgcatggcatcaatgacagagagtgacagagacgagagaagaaaaaaggaattactggatgagacaaatgttgatatagggaccgatcatgagacaatttattgtcaggtctaagaatagattctaccaggatatacaattgcgactggtaagagatttcgagagtgaaccaatggacggcaggccaatttcccagctgccttggtatccatcgaaagcgctcttccgcatccaccgtagctgttcccgtgcagtagtgccgttatgtgttcgtcagcacacttgttatgaatactctacgtacagtagcacatgggatttgattctagtttagccccagatgtagggaggagctgtagcaacctcgtaaaaacataataattgccgcgacgactagctctaccaatgtgaaactaatggcaggaacaactgcccatctttcaaaggtccatgccggatcgcagacgagacgcgtctgatatcttcatcatatgtaacacccgccgagaaagtttcgcagcaggatgtatagtcgtttgagacgggcatttggacttggttggttttggattctctttcttggcccgtatcccggctgctgcttacccgcaaacggctcgggagagctatgcaactaaaaaaacccactatctatgcaggcacttattcccttgcgtccgcaaaggtcgaaggcggactgaattttgggcctataggttctttgtttctggcggaaacggtatccgaaaagtccgatcctggagccgatatatagtgtccctctatagccctacaagtgcagtagtatcgcccctctccctccaatccattgttctgcaataacttgaatatttcttcagtttctccctcattattctaccaggtgcgaaatcaaaccaatcgatcgacatcagggagggcattggcaacgcccaaagacgacgatgttagacattgccgtacactgtaccgtggtttaatttaatacagtttgattggagtttacttagctcttaccagtactactcaaccaccggataagtaaacgccacgggagtaaaacgggccacatctcttcctagcgccgttcaagacgtcagtgtccattgtcattctacttggctgttgtgcatccacctaccttattcggatcggtatgcacctagctgaactagtgggatggattccagaaggacccactaatgacatgtgtgtgtaaagtgggccttttccaaatgacagcttcacaaagacagacgtccgattcccccgagaccacttaacaacagaaaagaaagtcagtgtctttgacaagacctcggacaaggccttgacagggacctcggcacctggattatagagatgtcggacacaaaggtccgagagattggcttttgaggaatggagctgttgttgccagtgccgtaccatggtcatgggtgtcgatggtaccagggaccaatcaagtccaagtgctgcttcaatatcgctatcgatgtacttgtcccggtacggtactgtgcaatacaacagtgtacatggtgaggttgaaccgtcttgttcacatgtccactgtatgatatccgtgaccaaaccaaagagacttgttcaatgatggaggagcctgttgatatcgaattcctacacgggctatcaattcctacacgggctatcaattcctacacgggctatcaattcctacacgggctatcaattcctacacggactactgtgcagtgcaagtagttagcccacattttgggtccccatgccactacaggtacatcgtcaagcgtccaatatgattttagcaggggctcaaattaaccttacctctcagccgaaagaaatacgaaagaatacgaacatttgctcacaggcgatccactccgacacccgcagttgtcatcggcagtggagattccttgtctggggagcgttgtcaggggtgttggtccgatttatgcctgcctatttgggaggagtgggggaggaggagaagatacttgaggtgggcaaactcaagcagctgcttatttggcttaaacatcgcttcagactgtgatgatgcacccctggtgcccactcaaacgagttgacgtgtgacataatatccggtagctcgctgcctatgggtatttgtagctacttgtagtggacgctagtggcatgacttgcaagcgcttatatttgttccagggatataatgaaaaggctgtagaacggaccgcaggaagtttggccagagaaatgacgtacactactaaactgtagaggacacaatccaaccatccaagtgctgggtgaaacacactaaagactcgactgacacacagcggcggaatctccacgtcattccggagactcctaccgccctgtacatatcagtagtcactcgtttttcctttctctaacatcatcaccatgtcttacaacgcactgccgtgtgacgtgacagaatcccgtcatgcaatcaaatgtcagagctgctacaagtagatgactgtcacaccatgtactgtgctgcattgaaccgactgtctgactgacagctacgaaacagccgcaatggcgagttataaactaaacccccatggtcaacacacgatcaatagattgatcactgctgcatatatcaacaggtgcagatgaaacaagttaaccagggtttaattagcaacaatacgagcacggtaggagtactgtagtacttatatcgctcaaagactgtcagggtgctgctactgtgctgtagcatcatgaaccaacgcaaagggtaggtgtagccggatacttgacataatcttactgctcatacggtacgagcagtctaaatatctttgtatcgtacaagtagcctttccccccaccaaacggattttttgtgtcttttttgtgtcttttttgaattttttgaattttttttttattctcttgtgtgtttttggcagcctcgtgtcagatgcagcccagcccattattgtgtgtgttatttctcttaatattaatttagttaagggatccccccccaaaccacacgtctttttgtcacacatgtttggctggtcacgtgacatgattagctatttttccacggagaatccacgggaagttattcttgcatttttggtcgctacagcgctttttgagcttttccaattggattttccgcccttggaggggagggggatttattactgtagcacacagcacagtagtagctacagtagagttgtttccgtactttgtcaaacaaagttcggccccacatcttacgtctacagggtcgtcttatttagtcttaaaggcgatacaagaaaaagcctgcaaagtgcgggatgcaccttattcccgcatgtgaaggtgggaggtgcgctcacagtttgagagctggaccacctccgcgggagacaacaggggcgggggtgggtttattttagcattgtccgggatcggagagcgtctgtgtagttgccccaacgcaaggcaagaagacgaagtagaacaaaacacgccaatcgccgcgcttttgactcgttgctgtctaacctaaccgacagatcttcgatacgttcggctgcggcacaaagacgaagacgccattgtagatcgctcacacaaagcggctatatgaaagtctcatgcacaagcgacataaacgcaagtggccatggctagcgagtgggaaagtacaaaaacacaaaatggcagacgcagaggaacaagcatagtatacagttggcgaaccttcggggggaaaaaagagcaacattccgacaagaacaagaagaaagggtagaaagtgtaaaaaagtgaaaaagagacgagaaacgagccaaaagggcaaaagggcagaaaggacagaaaggacagaaagggcaaaatcacaaatgggcagatgagcagatgggcaaatgggcaaaaaggaataaggacaacggggcaacagggcaacagggcaacagggcaacagggcaacagggcaacagggcaaactggaaagttttcatacagcaccgtaatttgtacaagtataagaaagtagtttgcaacttgtaactctgtctctctcccattcacactgctccagctcgaaaaccaggaagcaaaaaaaaaaaaaaaaaaaaaaaaaaacaataaaaaaaccaaaactgtaatgaaccgtctgtcaaaaaaatccttctatgctttgcggcgcgaccaggtgcgtcgtagcagtagggctcactacgagccaagagagtgggaagaggggtgaggcaaaaagagaagcctacgtgagtgactttttggcaagcattaggagacccacaggttccggagagcttagtcatcgataatgttgattctcgctacaagacagtgacggtttcacggctagcgacagatcgattgactgcttgactgcctgactgcctgactgcctgactgcctgaccgcttgactgcttgaccgcttgactgtttgactgcctgaccgcctgactgcttggctactgggttaattcttggccacctgcgtcttggcttgttgacaccctgtctggctgtccaaccatgttagtgccaaaccctctctagtgtcgtgtctgtggtgtctagggctgcctcatgtgtaaccagtgctgtatatctatggggaatggggagcttgtgacgattatcttgccaatttttccgagatatgagagacaagtgtgtcttcgtttctgaagtcgtggtgttgttagctcctcccagcgatcctacactgaggagggcggtgacaattccatgaatgggggcttcttaaacacaggagtgaagaagatggcacggcgacgataccatccacctcccttcatgtcaacagagacgtaaacatccctctgtgcattgtctcagcaccagcgaccgtctaaaactggacttgctttcttattcttagcaacagtagcattaccctccgatcctctccgatctgtacgaccgaatagtgtgtggccccaagtgcgtgtggaggagacgctacacaggcatgatgactttgacaagttacctcgtcgtgaccgtgtattgtcgacaaccgtgtgttgattacaacccggggattgtcaagtggctgtctgtgcacattccccacccagtcgccaagtcaatggagataaaggggtcatcaccagagacagctgtgagtatgagagtgagcaatttgatcggtggacagttgatggctgggtagttgatagacgggccgtccagggacagatgatcggaaggacttctcacggatgattgactggttaacggctgaaaagtcgttgggctagttgatgtgtcccagaaaaaatctgtacttcacagatgatgatattccgagtctgcctggcgactactttcacgagtgttcgtgatgatattgtctgtcagatgaagtacatgaaaagatgaagccctagtctacttgtacaagtacttgtacaatataaatgctcctctcggagccacacaccccagacagtccaccatcaccagctatttagacgttgtatacaccagactaaacgaaagcacttgtccaatcacagaagacaccactaactatcgatagatacaatacttgtaaatgcaagtgtgtatacaagtttgttactgactgtgatattagcatggactcgattaattgaactcttggatctctccaatgtctactgtatcagggaagccgaaaaaagcctggaggaccccagagacactccaccattgcaattactgaccaatgtagttgctgtacagacactgcttcttcaagcactagactggtgaagcaccaatcggaccactgttacttcactaccgctcttgtgcttctcaacttcttgagtctctcgggtattatcaccaatcggacattgacaaacgacacatcatcacactaaacgagcacttgttcaacgaccaagtccaccaagtcccatatgacatctacaagaaaaattctcgttgttcacgcagccacttgtcgtgcatctacacatatggagagtggctctcgggctgtttcataaagtgctgtactacaagtacatgcggtcacggacgtcgatatggtctgatacgaggcatggtgtcgaaggctggaccgaatgacaccgcgcccacaccattttagtgtgagcagcagtctcagaccctcctaacgcgattctatgatcagcacaaggtcaagcaggcgtcttgtgtaaaaaaatttacagcccgttacacttgagttagtcgtccggggaggattgtgtagtagggcacaatccaagtacagtccaagtaccattacgtgtagaagttgagtgtggatttctatttttcagtttctgcccacctcccctttttcactctttttcggtttttcctctgtcacattgtcccgggaaccaagccgtagttggcacaggaaatgtgacgacccgtccggcggcatatctcatggatcttggttgcctgcgtagatctgcgtttgtgtttttttgcagacccagtattttttgcgattcctgtcgattttgcgcttttcccaagcacctctgtttgcctccctttgtgccgccccttagacatgacacacaaaagcaaatagtggttcgaacaagtcggcaaaaaaccagaatgactccgatcccccaatcattaccgcgtcgagagctgtcacaccacagatacatcctcttcccaaccatctctgctgccctggagtttcggcccctccccatttgctccaaccttgcatttttgaatgtacctgtgtagatcagtttgagaggggtttgaggcgcagcgacaacggtacagtacagtagagtgcagcagcagtttctgtaccgaagagtgcagggagtgcatattggcaagagaggcctgctgggggggtctgagtctggattgtgggagtgtctgttatgctccactccatagttttgctcagtccacggcgcgtttcccgaaaatccgtggaattattatcatcacactatagatgaacggttgtgttgggggtgttttacgacggcactccaccaccaccaccgcgtagttctttttttttctttctttttttttggagcagtcctccgccgactattacgatactagttgcgctctccgtcagtaaaccctgaccccacctggcaccttatttgcccgaagggaaaaagtgccagtttcatatatcactttgctttttcttgtcatactacattacaatagggattgttcatcgctatacgtgtgtagccatcgaagtacaagtagtcttcggaacaggtcttgtgcatagaaggctgacagaagagttgaactggagggccaaaaacgtaaaacatcattggttgggcaagaagataaaacaaatgcagactagtggtccaacaacacgtctaagtcgctagaccagtggacatttatgggccagtgcggtttacttacaaaccagattgagttgtgcccacaaaaatgcggttaagggcgtttttgctactggacttcgcgcttgagaggcacaaaaagtgactaaaacataaaaaagggtcctaactactgtactgtgttaatggtatatacaaggatgtattgtacaggcatgcgagtggcatttcctctctgcattcaagtcggcctgctggagcatgtccaaggtttctaacgagagagagagagagagagagagacgcgaactgagagtctgagtattaagtatgtgagaagaggtggaggatgagacattgattgtcagttgcgagtttttattgcgaaaatcgccaaaattctggggaaatcagctaaactcgaaacaatgcaaataatggctcttcttttctcaaactattccgaaattccatccaactccatctacaagaacttgtcgcttgtaaccattcgccatccgtcgtggcttcgcttatgatggactgcatcgtctacatgtggatggatgcacaacttaatgtgagttttttttacctccagctggcgacaaaagcgaaaaagagccgactcccaagcaatggagatgcaagagcactcgcgagaaagaggggacacctatacggcttggtggagatgatgagtagatgcttgcaaagatgcgcctctcatgtgccaccggaaacagtgcaaggtgggaaacggcgacccacgggggggtggaggagatgtcacgtgagcggagcttgtcgggaggtatcggcagttagaatgagaggggtacttctaccgagagttgttcttcgttgttgttttacggttttttttttttttttttttttttttccctgtgctggtcgcgaaatttattcttatgcgaaaacaaacaaaaacgaaaaaggaggaggacccagggggacaccacgaacaggccctggctctactcttagtaagcgttatggctaaaagctagtgctccaaccttatgtggggtttccgtttctagcttttcacatttgaaacgttaaacaagatttctggctccgtccgtatgactttgtgtttttgaaagtagccggcaactttgtgtttttgcacctcatcacgagaaacaaagagggtggaaaaacgcaaagtggtgcttatagagagcctaaaatgacacaccaagacactcgaccaccttttggatataaagaggcttagagacccaaattacaagggctgagtggcacttttgcgtcactattacttgacgacttcttccccgacacactctcagattccaacaagggctcctacgaaacgacctctgccacaggtggcctccttttcaagatactctcgataattatcccaaagggccattgcccaccaggtgagtacggtgacaaagtgatgatgatatgagggataggactttggcggacccgaccagccctgaaaacgtgatactggatacagataggccgacagaacgacagacagcggacagacaaacagatcggcaggcagtcagacagacagacagagatacagacagagatacagagcgggaaacagatagggagacagacaggctgacagacggatagatggacagacaggcagtcattccatcctctacacaagcccccaccagacagctatgatctgacaccgcgtacagcacccccttgctcatcggcacagcagatcgcaaggtagatccatatccagggtcgtggttctcaaagcaattgagcggttaggaccactttcgatacttttgtgtgtggagaggccatcagttagacgtttctttttcgcctacatcttgcctccgtgtacttcacaatagtgactgtttatgcaacttccgcacatttctgcaccgctccctctacatttggtactgtcacccaacacccacccaccagagagcagagtttgatgttcaccgcacagatgcgcaacgggagggcagagtgatcagcggattgtatctgcaggaaatacctctcagggtgaaaagactatgtttgcgaatgcagggtaagagttgggtgagggcaactaaggtgaggaaacaggacaggagcatatgtcttagtcagctgcagcatccaggtcccaagagtgcaaaataaggttgcatgtttccttggcgtctgctcagcacatgcgtaccgccgaaactatgcacctacgcgcgcgaggcagtcgggacgaaagaccggaacaggcaacttagtcggaggaaggaatcggtgcggcagcaagtgcggttatgcgatccctccgcctcctccaccccttggctgtcatgatctggtggggtcgcctgcgtctactgtttgtttgtttgttcattatttgttctctagcaatatgtgccaggctctgatattatcgtgtcagggtccgagttccatcttgctactgtctgtggttgttgtggttggttacgaaatggatccacttttcaggggcgtgtctacctctatttttgttcaacgtcttgtcttgttcatgtggtttttttttcgcctgtgcatttttcccaaatctttgtcagtcctgagccggccattttactgttttcgatttttttccgcttgcggctagctcgatacttctccgttgcaccgtttctgcaagccctgtcgctacatacagatattcatagcggggaaaaagccgaagagacaacaagtgggccctattgtactctgtgtgtaccctaaccccgacccgtaccgccatttaccagaaatcaagtttacgcatgcggcccggatacgtcttgctcggcaacaacttgtcacttgaagttggccctctaggtttggcactaggacctccagtggcaccttcaggtcggcagtgaattgtgggctctccccccctcccgagaagctgccgggggttctgcgagcgtgatatacctgggtgatgtaccgggtgggactcggctgagttctaggcatacatttaaaagtgcaagaagcttcgcggacatccggctatgcagtggatacggtaagggtgcatgcatctggatttggcaagtccagatcagggaggggtggaaggaaaaacaacaagcgtaccaacacagacacagatggaggcaagcaaaaatacccgtgacgcacagacacgatgttatctgcttttttgtcacattcacacaaaagtccccgacaacaaactaaccattagtacccatgacgccccggctacctctgccaatccaaccacagagtatcaacccgccgccaccgcagtcgccccaagctaaaagagaagacctcattgatgctgctgaccatcacggtcgagatgacctgacgtcactcaaacggcgccgtctcgaaacggtggggtcacattcacccgtcccccgaccctcctcggcacatacacatacccagttgtcgcccaacggccagcagcagccaccgtcgccttaccactacccttactcgcatacaacaaactccactcatcatcttcagcatcagtcagcccaattgcatcagcccccgccgccgcaactgcaacagcagcatccaccgccaccaccgccaccttccctccacgactatcattacacacatggccctccaatctcgccaaacatgacgcaggcacctcctgctgtccagacgccaacacagacacccctgggcttgcatcaaccccatggcggcattcatgggcctccccctccccctcccccaccacaaaccctgatctaccctcaccagcagtacttttcgccgtatggtgttggtgatatgcggtaccccacgccgccgcagcccatggctcatgcccatggtccctctggccccatgcctcccatgggcccaccacactcgcatctgcagcaccaccacattcctccacccccgccacatctgatgggccaccaaatgcagcttggagtggctgtgcctggcccgtcgtttgctctgcgacgtcccattccggcacgccagcggacctctattgcatgccggtactgtcggcggcgtaagatccggtgctcgggcttcgaccccgagaatccagactcacgttgctccaactgcattcgcttcaaccaggagtgtgtgtttatccccgtgagctccatggcttccacggacaaaaagagcggtagcgccgatggggctagtgccgatggagtgggcgctgggggatacgaccggctgtcaccaacgctgtcagactctgacaagcgagagtggaagcctcagccgcaccccacgtcgccgaccgagattcgcaacgctatttcgcctgccatatctccgtctccgcctactgcagcagcagcatcttcggctgcggcagcagcatcttctgcgtcaacgtcgccaacgtcggctacaagctccacggcacccacccgtagcaagttaagcatccaaaacttgctaggctgattactaacctgtaccattatttaatgtaaactatgtatcatattgcgacttgtgtagctggtatcatggaaactgatgttgatgttgagtgaacatgaaatattatttacatttagcagagcgccaggagttccgtagtgcgttggcaaccatggctgcttcggccctgcaacctgctagcattgatggccgccccggttccagatgcaacgagagcgcgacctcagacacccgccaatgtttgacctatttttgttgcctttctttgtcgtattttcgcttgtcggcgcaaccctacgttgtatgataatataggataagtgtttctattgtgaagtgttcgaggagttagaatttgtggacacaattaataatacgagtggtctagacaaatacgagcccagggtgctcttgtttcccccttgtcatgtgaaggtgtcgtattaaaccgtcaggtgaaagggtggaggagctgtctttcgttagcctgagggtggtttggagctagctcttggtgcggcacgtttggaaagcgtcttgtagtttcgagtttcgaccacaggcatctccgtggtccagtgagcaccggacccacccgatattggcgggttttagcacagcaataacctacaggggtgttttgcttttccggcttcttttgtcactagtagcgcgcccggaggtgttaaactagtgcagcgaccatcatccctaattaaccaacattgtgccaaggtataggggctaaaaggtgcaattgaagagccataggtgagtgatagctcgatactaccgtggttggtagctgccacgacgatatggctgcttttccactagtggccgacaagctcctcacggtggtgtcactgtcaccacacatgcagctatttctctagccagatctactccatctgccccttggcccaaatatgcttagtgtcgctgcccccttgttgtcccttaggcaactctagcctcagcacattagcacatgcccgtgctacttgtacgtctaggggcgacagctagattagctagacaaaaggccgcttttagcagagccacctgtatcacaaagggtcttggaggttgtgcagagccttatctggtaggttcttggctacggaccgagagcgattctggacacacttgcgatgataatcgaaagttggggtgttgtgcagtccgtgcacttgtgacgcacacaactgtgagagcagacaacacgcactgctgctgtattattactgtacttacattagtgtgcagcagcatcatctttgacattggtcgaggcattaatagccgatgcgacaccctcctgtcagctgtcaagtgggagatccacacgtcaggctagtcagtagcgtgtggcggccagatggctgcatcccagccgtttcagaagcccggtccgcggggatgatggaacagggtctacgcggaagagccgggaaaagagacggtactgtacacggcacatcggaagcactaagccgcttcgaaatggcagaaaacgacacggctacttagtgtagtttgagattcacctcgtgctgtgctgttccccgcgatatgctttccattcctccattgttttgactgccttgtgccaattttcgttggactcgtgcagctgtcgttttagcacggcaacctcactatcgtgatcgacttcaggtagcgtgaaccgttgcgacagggcatctcggagtgaagacaggttatcagccatagtggctgctagttcattaaggtcatcggtccggttgagtgaaaatgtgcctccatgctgtaattcggacacggacaattggacgatggagttgagatcgtcttccgtcggggccttgtattctcctggttgggtctcaagtgcattccgtttcagcatgtcaatgtcgtcgatagttttgtagatgagcgacagcagcattttgttgtctctgatgagctcattatcaagctgtctgacgtctggtgatggtggtgtaaatgtcaccagcgaatcagaagagattgctgtcccttttcgggccagttctcgcattcgctccagtcgaacgtcccgtttgcgcatttcaaccatactctgctgcttgaatctgtcgacggccatttttgcacgcgtaagactgcctctctcgttcttagctgcggcttccagcctcgcaatttctcttttggcgttctgtaacgcgttctcctcgtgagctagacgcgtgtgaagatcgtgatttttgcgatgcagggcccttatttcgttgcgtagacggtcattgtcgtgctccagatccgccactcgcctcagccggttctcttcggccttggagtccttttccagagactgtagcagcgagtaaatggtgttgatcaccagcatgtcgttctcctccacattttcgagcggcgttttggaaacggttgcaaacttgagtcggtcactgagaaggtagcccttggataccagcgtatgattgatgaattccgcggccgcttccatcgtcttggtgtagtgcgatgtgctgatttttcagagtcgcgtttccctcgcgttttacatgcaccaggctagatagataagggaggagctacagtagggtccattgtacaaagcgaagcactgaatgggagatatagaagagagaatagatgattgcaaatatatccaacagttagtgcggaatggcttaccttctttagaaataatatcgcataaaaactcttggttgggattgctctgaagaccagtttaagacatttttttttttaaactgcagtgtctaaccaatataactaattagttggaatatgcagaccaattattgcaggaaaaaattcagaaaaaacctaaccaattgagccgatatataaccaattgagccgatatatagcccatgagccgatatgagccgatatataaccaatgagccgaaatataaccaatgaagacacccagcacttgttttctcagaccacggcgtttcttgacatcaaaccccaatgcgacgatgttcctaagcaaccacaatgatgatctttcctctaagaacaggggacaaaccaatgtggttggttcaaatgtacgaatagccagatcgatgcattgactaatatttcttttaacggcagtcgtctacgtccgttacattctctctacatgtagcattaatacagtacaagtaagatgggtgtagagctgcaataccatacgagaaatactctacttgggtctccgggatccgacggcactcaatctgtgtctgacatttttaattgttcgtcacaccttgtaaaacgcagtgcgcatcaacgcctcctctcccccttccatgcaggtttgtgcaccttgctttgacaacacccactcccccccatccaacattgcatcgtcttcaagaggaaaaatcccaggacaagtgacactcgagaccctggttcaaaacactcatgtcatactacagaaccacacggtgatgtgcatgtacaaggtcctcccactccaccattgctggggtgagacagtggctgtaacctcgcgtctgggcttgtggtggccccagtgactccgtgtgagacaccctaccgggacggataacgctcacttttgcacgacgctctttaactacgcctactctacatggcccggctaatgttgcacttcagagttcgcgcatcgcctacggtacggtacagtacgagcacttctagggtgcattgcagagcctgaacttgcggacccacggaatggtgtccgtcgatcccgtctatcgcagcttccccgccgttaactctcgctgatttgcccccttgctactgtaaatcgcaaactgtggggtcaagaacgagacagagcggggtggtgatacatgtacctgtatttgcactggtattggcactcacgcttgcacttgcacttgtagcataatacaacggccagttgcaactatcacatgcgagacactacggccaagagctctccctccacctgaaacccccagcagatgcttcccacatgtcacatgcggggaaccgcaaggaacacgggctcaacaaaaccaccgggcctgtacaagagggccgacaccgacacacacaagcagaaaacagccctgttgcgtcccacacaaaagcacaagctcttcccacacagagacaatgtttcagttttgcaaccttggcaaaaaaggttgcagattgccaaaaaaaaaccaaactaagtgcctattgaccgccccctcgtaaatcataaatgccatcttacaagcagccagcagaaaggagaaggctgaacgcgaacaggtgatggcagcagacgacggggggaaaaacacaaagcgagacgaaaaacctacgaacaagcgaagcgcatggaggcattacaacttatgagagacatgctcccaccggcagcatcaacctgcatgggcacaaagaccgttataataagttatttatggtgatgataaaatgatcggatggtggatggcgctggatatacgagcgtgagcacgtctactcgtacaggggcaggtgtgtataattgctggtccgtcacatgcgcactctgtcaagcgaagaaatgtgacccaaattgcttgatccatggacacatggaaaaataacgcccgctgcagcacatagtctctagaacacagtctctccttcctcctcgtccccacaaaacattaccccacccaagctctccgccccataatgtacatccccgcgtttttctcgttttcttctccgtctctctgtctattcaacctggtgatgatcgaaaaagccctcaacaacactggctgcaggacccaaggcagccactagcggagtggtttgcccgctcgccgcaggtgagaactgaggaatcacagcaggcattgttgggggcgcaaatgtagaccctgtagcagtaggaagacctccaatgccacccattcccattccagcacctccgccgttatccttgggcttgtattccagcgaaatggcaatctccttagtcaacttggtcagggttcccagagctgcagacgcattgcccagaatcggtagatcgtccatggcctgtcttgtagcggccaacatggcaatcaccaccttgaggaagtacgatgtcgtgtccaggaactgctgtcgcggcgggaaatcgcctctggccactcggtcaagccgctgacgtacttggcgagtcgcgtctgctcctgccacacacgtggacgtgagctccttcaccaggatggtcacgtgaggcgaaatggtgcctccagcgtgtgcagacgcagctgcgctcttggagatgaactccgtcagctgtcccagcacgttttgagcgcagttggtcgcactgatgagcttctcgtacagcgctcggtctgcgggagacacggtgctgaacttgtcgggctcattaggcggaaacagggtatgccacgcgttatggacttcggataaggatccaaatgtcgacagaagcatcaggcgcgtgtaccgaatgtctgccgatgcaaacaaggcaatgttggaatgcaacagcgccagaatgcgccgcagagagcccacgcagagccccgccctttccacgacggcagattccactgtagcgtcctgtaccgtctcttcatatctctccagtgccgccagtagtgcctcctgttgttgctggcacgtgccatgtagattggccgctttcgccaccagttttctatctttgcaaaagccgctgtatgttttgatggctggcaggatctcagaaaaggcaaagaggatttttcgacacgcctcgatcgtgttgtttttgcgttcctcgggaagcgtggacagccgcttgaagtaggctcccgtggacgagccttgaccttggacgggatctccaatggctgagtcatgtgacgccccacgagcatgtgacgtggtggatcggtattttttgacaatgacgcccattcgtttggcctgtcgggacgaaatggggtcatcttcgaggggtgtcactggaggcgtggtgtgcactgacggagcttgtgcttgtgttggtgttggtgttggtggcacttgttgtggtgtctgtgtctgtatctgtggcaactgctgctgtggcaactgctgctgtggaggtggttgtattcgtttactcctcagccactccttgacttcttcaacccaatctagcactccctcggcttgtgggtcgacacatggaggaggggggtccacgaacgggttgccatcaatctccatgagccgcagttctgccatgtccgcgatgaacgatggcacatggcgcagcttgttgtgtgaaaacgacaagaccatgagattggtgagccgcagcatgccctccgggaaagcctccacctggttgtaggagacatcgaggatttcgagcgtcgtcagccgagtcacaaccgcagggacgttgtgtagagcattgttactcagatccaagtaccgcaattgcgtcatatggcccatgagcggaggtaggtctgtgagcatattgcccgtgagagacagcttgcggacccgcaacagcagctctgccacgccatcactcacctccgtcagtcccatatgattgagctccacgccgcgctcttcatctcctccagcctcctccaccttgcgttgcacgtcttgaatcaagtccatcgaggttggtgagaacaggtagaacggtcgtatattggcggacccgatagagttctcctgcagctgggagaagagggatgatgatgccatgtgtggatgtgtggatgtgggggtctggtggactcctagggcgtacgtggcactggtatttatgtttttccctggcttatgtggttttgtacctctttggaatgtggcccaattcgtttctacgtgcggcggccccgaaaatgtgccgcaaaaggccatgaacggttggaggggtagaatatttgcagctgcaaccttgtaaggagcggtcatatgcagtgcacgatacaggatggaacatggcaagaaataggagagcgagtacggatagacaatgggaaaaaatcaaataaaaaatggagtaaatttggtaccaatgttagcttttttctctttttttcccgaattaattcgaattgttgcaagtgtttttgtgttgttgcattcttgaaattacgtccgtccttatttcctaatagttcaagggaatatacagtaataacaataataatgaaaatggggaatcacaactgaaattaacaccaccagtcaaaacggtgtagcggttggcggttgagcggggactgtaacatcgtaagttgtacggtacaagttatttattggtactgtagacatattttcggtacagtaccggtggttcatgttgaaatcagccacccgcagatctggtggtcatgtacatatatatacttactgtagacgaattcctgttggtatcgtcgacatttcctgtctgctatactacgacaagttacaataaacagacgtgatagtcacatcagatgataacaacgacgtagggcgttgcagtatcaccgatcgatttatccttcatgtctacgttggagtggtctcttgcactctacaaactccatcagcgatgatgagttttgtacagtggttttctcaacctgggcttctcaatctccgagagccttgtcaagacgtttggtgtactgccgttcgaacgcccttttgggctgtctcgagtatgcaaatcaatctcctcgcgagtagcagactctcggaatgtcttaaactccaccattcgatcgctagactcgtgcaagaaccactcgggaagccactgaggagtcttcttgtaaacatttctttttgttgacatagagacccctttagaggtggatttatcaagtgaaagagcaacaatagggtcccaagcgccaaaataggggaaacaatgcgcgtgtaatcatacgataactactgtacttgatcccacaagcctgtttctatgatttacaagtgagatagtggtagttgtacgggaggggggggggggtcagaaacagatggcgtttgtatgataggcgccgtggtatagagtcagtgactgtctaaatgagggtaaaacaccatcaggatcttcattgcgacacacgatcaaccagaatccacgtttcatcggcacaaacacggctgatagcagaggatagacacaagcacaagcgggcaggcgataatcccactacccggggctagagacacgctaaaaccaattcaacgagagtctatagacatattggtgtagtcagtcacagcgcctccgcatgttttcttttgcagaccaggtatcgtttgtactaacacccacccactgcttccgaccctaacccccttgtctgccgaaatagctgctgaaatagtgcccaacgtcaaaattaacaaatgcagggcttgcgaccggcatgacgtccgggccggtgttaatgctgtatgtcaaccagggggagagccggtccaactatacatgtcaccagcaccatcacctcattccgacggtctccttagacttgaagatccgatccgtgagcagtcacgagtgagggagtccagcttgcctcgaccatgtagcaaaaagaaaccgggaaaaaagaaaccgggcaaaaagaaacagtgccactggtttctcgctcgcaaaagaaatccggcactgcacaaaaaggaaaccgatcttctatctggtcggacgaatgcggaaaaaaaagcaactgttcccgcagtctggtgagtatgggcagagtataaatatccgaaccgtgtatctggaagcagcttaataagctgatagatagcagagattgatgcagaaggtgttggttctttgatttcattttgcttgtcccctctcaattgtgattctgcttaaccaatgtttccactgactgacttacattacataagcagtcaccaatttacattgtacttagctaacccaaacgggcgccgagacaccaaaatggaagacccccctccctcctcctcccgcactgagtttgaatgtcttgtctggtgagggaaaaaaagcagttccgtacagcacaagcaggcaaaaaaaaagcactgtgtgtgagcttcttgtgcatagggtctcttgttcgggctgaatccagacttgtgtttggaaccaagagctccgactcgcttgtgaaaggtcctgctgtgaagccgtagcctgcggagttctcggggaattggcacccacaatggtcgtctggtcgatagacaggactcaacaagtacaacgaagatcattctgcaaccgctgcttggcggcgacagtctcgaacgtatgtatgttcaagtacgatcccgactgcacaaggtatggcctgacttgatttagatcggcctcaccttacatggagcatggtcgatcatcgcttgtcttgacccctcaaagatcgtcgtccctacattatagacttggagagcctgtggaacatggggaagcgctgggggggcactgacacagtttggagctgtacagttccccgggttctccggggtcaggtaccagacgaagacaaaaggaaccccgccatggaaacctccaccatcatcctgcccctccccctcccccaccatgccccagcttctttgtgacgcctgtctcacctcgtgaacccctagattatcgctctcacccgccgcccagctgcaccagagggtaccagtaggggagaggcaggtttcaaatgcatatcctgtctcacgttagcggaccaaatgagccgtagatctgcatccgcatcagcatggatggttccgcggttcaggagcaactagcgttggttggtgcgctggttgcaaagttgccaggatgtgcaacacactgccgccagcttgcatctccgtttcccgcaagcttaacccaaaccgaaaaatcccgagccaagagagagaaggccccccccttcagtggttgcccaaagctgtctgaacctatacaagaagtaccttcccgctcgtgcaccattctacagtcgctgaaaaacactctgagactcgtctgttacaaactctcgccaccttgctatctttagcacaggtgaaactcgagacattcatacaagtcaaatagtggcgatacactggtgatacggaaccgatagcatcgcaacttcaccgaaagctttacccttcgattgtcttaccgacgtaacaagtacataatacaagtgccggtacagtccctgtatgataatgccctggcagaagtatgactccaacatagtacatccagtagactatgtttgcggtcattacagtagcttcaatagataagagacatcgggatgtatattagctcttgaactcgtatcacggaccatacggcactctcctacaactcttgtacaattacattatgttcattatctatcgtccattcgaaaacctgctggttggatttcaaatataaccccaatgctgagctccagagattaaatgactcatggaaaacagtcgccacaggcatacacgagtgaggtgtatctctccgcgctctctcgttctcttgccgtatgtcgtttcaccctcgtcttagtgtcttaacactcgttaatcgccttcaaccgtgaaatggccttggggtgcttctgggcagcagccttgaaataccacttcttggcctcgttcagatccttatgcacaccaatacccacctcacagaagtatcccaaagcgtactcggccttgaccagacccttctcggccgcctttcgagcccaaagatacgcctccgtatcactctgctgtagaataccatcgctgccggtcaggtaccagcccgacagagccagttcagactcgggctcgcccttctgagctgcataggagtaccaagcaatggactttttggcgttgacatcacagcctagagttccatactcgtagcagcagcccagacgaaactgagaaggaggataaccgagcttgcctgcagccatgaaaagcgatagtgctcgagtctcgtccttacgaaccacagatcgcccatcggccgaaatcgcactcatctcataagtgggacgctcatatagaagagccaattcatgaagggcatgtgggttctctgaatcagccttggcagcagcctcttccaacaacgcaacagcctcctgaatattcttctgctcccctagagtgccgtgaaggtgagtcatgccaagcttgtagagagcctttgtgtcacccagatcagcagcccgtttgtaccacagaacagcctttcgagcatctcgtcgggttccaatacccagctcgaaacacactccgactctgtaagaggcctcaggatgactcagaccggctgccttgttatacagatcgaacgctcgctctttgtctgagctctggactccatactcaaacagagcaggcgcatagttgacggcagccagcttcttgacaatcttcagaccctgcgttgtccagtagtctctatttttcttggctgttttcgagtcgatggggtttccgttctgggccttgtctgccagttgagctgcagccttgaacattgcctgtgcgtactcaagctgggcatgattgtcgtctgggttcgccatagcacgctgttttttggcctccaaagacgcatgcgtgaatgtgagactactggggctcgggaattcactagtctttgcttctgagcctcgtcggtcgtcaccaccacctccacgaggatcttgtcgtcggtcatctgaacctcttctgtcatcacctcttcgtccgtcatggttgcctgtcttgatgggatagggcgcgttgggatgtgaaaaagacgcctttgtgggcgaggggtgcgataactgcgctgccgcttgtgctggtgatgatgtgttgatatgcatcgggggcttcacaggcactgctgcaggaacgtccagtgcgtacttgctgttctgaggctgaggaaccggaggaggagcatgtgtaggcagctgagtacgctcttcgtcgtagggattctcttccttgtagctgtcaacgtactggtgaggaatggggttgacggggttctcgggttgaggataatgcgacattcgcacgtagattttgcgctcgatttccgcccctcggttgtcgctgtggtttgtgtttgtgttgtacgagtttgacgctgctgccgacgtgaactgaaagccagggttcgagtcatgggaatcacgcgactcggtgtttgtaggcgaaaacgtgttgttgctgcctctgtcgttgctgcctctgtcgttgctgcctctgtcgctgccacggttgtagtcgttgctgctgtggttgtagtcgttgctgccgcggttgtagtcgtgcagatcgggcgtgctacgagacgcctgctgcgggatggacggttttaccacggagctctgcccagacgcaggcgcaggaaccttggccttggggagagggtagggcagatgctgggcctggggcgagttccgtttggccactgtggctgcatacgactgcacgggaggccccgggttctgcaatgggctcttggatcgcacactaagattgttgatgcctgcagtgaggtccggctccgactgcgaaaacgcattttgttgcggctgctggtaactgttgttgggatgatgctgatactcgtcctgtcgaggaggatacgactgtggctggcctccgttgttagccggctgatcgtactggtgatcgctgtaaccgtggttgtcgtatccttcgtcgttgtaacctccgtggttgttataaccctggtcgtatccttggttatcgtatccctggtcgtagccctgatcgtagttctggttatcgtagccctggtcgtagtgcttctgggcgggaggtggggcgtgagcttgcttgtgatgctgctggggaggaggagcatgctgaggaggcgctctgtaaccctgggggccgcgttggggaggtggtggttgctggtagtgtccatgtccgtgattctgaggtggtgggggagcattctggtagccttggttgtagttctggtcatacccctgagcccctccgtactggtcgtagccctggtcatagccctggttgtatcctcctccgtattgatcgtagccctgatcgtacccttgatcatagccctgatcgtagtattgctgctgtggaggcggctgcacgggcttggggggcggttggaactgcttggccggtttgtatcgttgacgaggccccgggcctccgtgggattgcgctccgggaagtccgccaggtcccggaggtccaggaggagcaaaccgctggggaggccccggtctaccgcgtcgcggcacgccatacgaccggccgtagttcatgccgggctggttgtactgctgaacagaggccatgggggcgtctccaggcccatcgcgacgtttcagccggtctttggcaggtagggctcgtgagatgccgtccatggtgtggtggatgagaggtggtggtatagagttggatgggagtatgtggaatgtgggttaggaaagagcacgctacaagtgccaagagattgtacccgtgtacaagtacgtggagtctactgaatggtgatgcaaagaaagaggtgtgtttgtacggtagatctgactggtcagacattttttcttttcagcactccgattggccaaccaatgtacctactcgtgatcggtgcttcttttttttttttttaccgccgtcgctcggatatgaaatgaaattgttgctgatttgggacaagtcacgtggcaaacgcgtcaagcccatacagcaggtgggggacttgtacttgtacttcatcgaaggagtcaaagagactggaaaccgatcccttacgagctggaaattggctgcttcatccactcacaaaaccctcgtatcgacctcatcgacgatccatcggaaaccagacacaaaggtgcaacaagtaccacccccctgtctcgctcagaggttatatgctggagatctgtggagacgaggagaatgggccacaggcgggggaaacggttctgctctcaagactccgactagacgcgttggtccgttgtttttgcaccgtccagaatgtttttttctgtgctaagcagcactaatagaccaacttgttagcggggcatgtttttttttttttttttttttttttctgcatgttaaccaactgttactgtagcggggtcaattaactgcccaactacaagcattggttttttttgagttcctactaacacaccaggttcccgaaaatatccatcatctagccacctattggcttatggataccgttggtcaaaacaccatccttcgtttgatacaaacggtgttgtgtctggctccaaataatactctgaatttgctctacagtacacatgaaaacatcgccagtggtcggaaatagaactctatgcttcgtagagttctcggtaacccacatttcggaccagtcctcacatcgttctcaactaacgcttttttttctggacgcatttcggtcccattatagcggctacttggctgctaaacaggtgggggtctgccaatgtccacggactttttcaccttggaattgcttcttttagcgctaacattcgtaccactgcctttcatgctcatgcaatatcagtgcaagtacagtaccatacacggatggtgagacaaatgggtccagagacccgaaaaataagaagcagagagcaaaggacctcctacttgtgtacacttgttgttttttcatcgagatatcatcagcgattggtgcccacatttttgttcatgatatatccatggaatgttgaacaaacttcaacgacactccatggcacattgcaaaaagcacctcttacgacacacggactcctggtgaaaataaaataaaaaatgacatccaaaatgcagagtgaaaatggtgcatgcaattgtgttgtctgacgtctggcgatttttgcaagacgccagacagaattaatttttgttgtgagggtcacgtgctacatggaaattaagcttccgcttaccgcgttttcaccccgctcctatatacatgaatgagttataagactcatcggagatccatataacgatgaatacggcagtgaagcaagtcatgggacaaatttacgtctagtagaggcggaaacggcatttaaatgcttctttatgggtcaccaccatgcgtctgtggcatttagcaatcttggggatctacaccttggtatttttttttgtcttgagctgaaacacgaggaagtctcgtacatacagcactgtacctgaagtacttgttgcgatcgacaatcgagccgacaccccttcacccgtgcattttttttatcataaaatcatttttatctctttttatctctttttatctctttttatctctttttatctcctgggatcccacctccatcccatccataatcgatacaaaccccgaccacgaacctaagtaaacccaccactgctgtacagtatggaatgtctcagtggtgtgtcattagtaccgaatgcacgtaggtttgtgtacagtcaatgtctctacacactcattatctctgtctctcttcccatgtaccatgtctaccccacagatgcagaaggtgtctttgtataagcgagacagggcgagtgaaagaagcagaagcatttggacctatggtatgggggggactatttttagaactcggcgggaacggctgatataggcgtccggtgagtttgcgctcgcgtttgcgcaaggtctaaagtggtctctattattccctttcacgggcctattcgggctcatttttcaacgctactcgtactgtacaatgtactcgtactcgtactcgtgcagcacgcaagacttctttttttaatgtttgaagaggagctacccgccacattacacaaacccaacccttcttcccattgtgcgctctgtcactcccaccaaaaagggtcgtcaaaactttggtgcagaatgtctgaatattacgtctgagacaagagcttggtacatgtagtgtatgtactgtactgggttaagattacggttttgatttatgaagctgggacaagatcgtcgcgatgacaagtttgcatgaggcagggattcagaatttgtaagctttcgtaagcaacggtgcggctgcccgtcgctggccccgattgcgagtttcgatgaggcgaaaaacacgcttaatttcgggcgcttgtggcgcgttccagcgctcttttctgttccaagatgtcaacttattggatttcttttgaatttcctcatgattaacattatttatcaattgtcccacctccgatcctctccgacgcaatactcgatgatgtgaaaaagatgaaaataaaataaaataaatataagagagagagagcgagacaatcggaggcaaaggcgggtgtctgatcgattcccaccgacccacgtacttgaaattctatcggttgcagggtttggcgcgattgacaagcattctatggaataactaaattaataaaactacggtatagtatgtacgtacatgtagatttgaaatatttaaacaaaatatatatatatatatatatatatttaattttattcatttgatctgcgtaagtaataatcacagtaaatttatttaattaaagcggacgcaatcaaacaacatcaagtaaacgggggtccaccgcccaccgccgccaactacaactagcgtcaattacacttctccaatcatctcccgttttaattgtttccccgctagttccacatgtacgcctgtcttgatgcatggcaccattgtgtggccgattcccgtagcttttagccgaaaaagcaacgttatcaaaacaaaatctcaaacaacggcttaatccgtgctttagattcaagatctgccagacagacaaggagcaaattagggttgtgatgcagcagggtttatactttaagcctccctgcgctgcacgctaaaatggtgctgagagaaccaaccaaaaaacccagagaaaatgcaaaagggatggggggaaaataaccgagagcatagggaaaaaatacaacccggacacggacacggaaataactttgtccgaactgtcgtcgaacaaactacaggagaccctgcgacagggtgtagtttcaggttgagaaatacggcgacatagtgcagcatgtatgagcacagtacactggtagctggttgcactgtagccacacgtaccgtactacttgtactaatatatactcaaagatataaccatgttcctttagtctacatcatcttgcaaccccatttacgcacctctcattaggtgcagcagcgtcctagtaaacattggtcaaatgctagacacccgatgcgggcattgtttcattacaagtaatattccccattgggccgttgtttgcaggttggtccaccgttggaaacacccgactccccgtcaatgcaatggaggtgtatgaatcctgtaaccttctccaacccccagagtgatcttcacattccgagacaaatctcagtatcagattagtggggtgcaatgaccaggtctggacctacagacagacattgacgttgaatcggtagagagcgaaacggcctttgttctgtgaatgtctctgatttgtcttagtggttagaaggagggggggttgtagaatatccactctgtaaaattcccttccgcataccctcgtggtctttgtcctgtcttatcgtttaactcatcgcgctctgcattgctcaaccagggtgggcacctgacaaagctgacactggatgtactggaatccttcaatgttcgatgcacatggagaacaatggcttttcaaacaataaccagacggactttgggctggtcaatggtgtccttgtccccttgttttaagactgaatgcagcagcgacccgcgcgaaaatcgcccgaactcaagaatcgacagcgaaaaatgaaagaaaaaaaaaataatctcggctagctttgtttacagcgccagatcagattgatggcttttttgcttgtcttcgcaagtggtctgttttatcacctaatcgcgacgactccaacgcacggacttgactgcattctacttttacgccgttaaaacagtagtgtagcacaaagaagaagcgaaaggtcggcaaatgaacccattgagcaacactagaggtacgggtaccccaccatgaccaccctgcatcgacttacagcctcgttttcgtcgttttcaaatttttgaacctgatctgagttctggagccgaaagcaacaacctgtttcaggactgcaggggtagcatctagaacttagtgtgagggatggactgtctattctacttgtagctggactagcatggctgcttgaagatccatgtgaggtttcttcttcgacctgggtgcttccgaaagaggaagtctgcattgtgggccaagcgatcgcatactacaagtagggagtctgagcggatttccggtaacaaagtgaacaggggtgttccatgtgttcaagtacagtaccagatagtctctccgtaaagactctcaagcctcccccgccccctaatgagcactagagaacttctacatcaagcggcaactgaaaagtagattgaggaagcaattgtcgattattcaatcgaggaacaactgtcgcagtcatgcggacgcatagacaaaaaagaaaagtgtcaactcacgcttgttccagaagtctttctgggaatgaatgggtcccgcagtacagaccaggttgagataattatggaacatatcaggatgataggtcgacggtccagggacatgaggatacatttactagaacgaccctcagtttgttgatgctgatttttattttgtttttgcaactgtggaacacttagtttgaagttatctgtagggtggcgttgtttagaacccgtcttgctacaagccactgaaaaaaagcgaagggtagtgtctgtttattctgtagtagtttgaatctgcttacttctttcggtcatctttcggtgcttgtagctcctctgtttcaacttccagagccgtctgagtgagtgtgaaggaaacatgaaatgttggtgtgtggttcttgagaggtgatacgaaggggtagatggtcgttttacagcactgaaaatggttcttttcatctcctggtgttcttaatgggtctctatctgcgatattatttgagaaatgcgctatgcatcaccatatgtcattatcaccaatataatgaaccatagaagtggcaatacgacagtgaagaggatgagatgttgatcgttcgtctttttagacgactgggattgtttatatctactcttcaacttatccaactccaatatcctggcttggataatttatctccatttttatgtactaattggaaattaaattcccgaaaataatgaggaaatattggaagaaaggcaataaagacttaagtaatatatcaatggcgccattatctttgaatacaagccaattttcatggtctctatctatctgagctcggaagaaacatcattgatcctcaatattagttggtgctttttgagagtctgccgataaaacactcccaagagcccatgctgttggtatatggccattggttattcatatccgccacctggctatactttttagccagtctaccacgtattttccccttagccgagttcatacaagggtgtagcgctctgaactttttttctcgacgaaatggtagaaaatgtggttccacttcgcggactggagttccggagcaactacgtcacggtctatacaagattcagatacctacttgtagcattacttggtcttttgatgtgctgtcggtcagttcccgaatacgacatggatcttatgtagatggatgatggcgctagagttggaatgagataggcaaatgatggatggaaacacattttaggagaaggagaagttaacaattttgatccactcagtggatgcaatctttgattgccttccagctctgttccaaagcggtctagaaaacctactacttgtagtagccgtgctgtgtgttatgttttggaatccttctgatatggaagttaattcaagtcttgtatagaaaaggggctgttaattagttgaagtgcgtaggtggctgtcaacggagcttgaagaaacactattaccaatacctggcgccatgctgttgcaattattcttggagaatcttcccctatgcttgtaatgcacatgttgttggcaagttcagatgcccaccgaaatgatacccagtgccttgcccaccagattgaatagatgggtacattggcgatgttacgccagccggcagggagcattgacctttgtttttattgcgcatgatagtcgtcccgtatgtgcagtactcgtacatccatgtagggaggttggtgccgtgtgtgttggtttttctgattcccctatgcaaaaataaaacttgtccagtactacgactgcaaacgcgataagcaagaaaagacaatctggtggctgtgcacgttgcttagattgtgtattctaactacttgctctggttcaagtagattcctcccgtaaaatgtttatgaatatcaccgcgtttaactccggtccacgttttggtgagcaaaagtcaacgtcacagcaagcaccgaaaatcccatcattcaacggcacacgttcatccaacaatgaaactgaatctgatacgcactggtaccttcttccagagggccagttttgttcgaaactgctacaggtaggtcggtccctgcattagtaacacaaatgtgtcttggaaaaagggaaagaacagaaatatacaagaacaagaacaagtaaaagtcgagtagactccaaccctgcctggttagagttagttggagtcggttaccgaagcgcttggtcctgccatagggtgtagcatggcttagatgtgttgttctagggacccaccggcgctgtccttgtgtgcaagtaccggtatcgcacaagcgccgggctttcttttgaccgcgtaaatggctcatgtacgaacggctcaacccgttgatgcaggttgaaccctgtcatctattgggttgggcacaaactcatctgttgatcctttttgttggggtccaagtcttgtatatgaggaggttgcggttggtagctccaggtcagtagctccaggtcgctgctcaagccactcttgagtccttttggcctttctctggcttgttttcatgcagcagagccttgtatgactatcctccacccaactcatcttttggtaatgtaggtggatccgatgagacaccagagaaaaaaagctgagaccagacgagattaatatcagataaaatcagataaaatcgaaggaaatcgagagacctccagcttaatagtgcaggagctatcggaggctgctcgacaagtcctcgacaacttctggcaaaggtttcggctcctccggctgccccttgtatccgcgcgaccgcctacaatcgccaggattgctttttccagcatttcttttttcgagtttatctcggctcatgctacgacaatctccgtattgcattttaagggcccctaaaacggcttttttcaaggaacggcgcgagagattaacattcggaagtcaccgagtccgtggagctcatcaaactatcacgcaaaaaaaaaaaaaaaaaaaaaaaaaaaagacatggtaaaagtatcttgaaaatcctaaagaaatctgtcgagtggttcgaaaagcgaatctaaaaaggtggttaaaaaaaaacagtggtgatcgacaatccattgcaacgggtgttctttacgagacctactgacggcgtacatttacttgatggacttgtttatgcaaggtgaggggataaaaagaaaatggatggacatggtgccggggtaatcgccagtaagatggtggtctgaaacacgagagaaaatcagacgattccactcacccacagttttacaagtgcagtatgtactgtacatgtataatttgtttttagacactgtgactgatagttggcttgtcaaccaccatggtgggtaagagagagcaagcaagcaatcatatgaaagcaatacaaataatggtgcagtacccatatttgtagtggcaacgtctgtgcagacaaacttgtcgaagactttcgtttattgactgatattacatcctagactgctggctcacttaaaagcgtttcatctggaaagcccgttcatcccggttctaaccaagtgtactcaactccttcaatctcatgcaacaccatcttagtcggtcgaatatttccacaacatcagtgctacaacaatcgagacttgatcgcagtaatgagctcgcttcggaggatacattgataccagattctgtaggttaggggcagacggttcggagcaattcaccggaaacgacagagagagaacggcaaaccaagctgttaacacggtataaatgaacactttctatgttaaacgatatcttcaatctcagcgggaacatcgcccaaccgggggataatgcttactgttcttgctccgagatccgacatgatcccctacagtatgtacatgtacttgccccagcaagagcaaaccaatatacagtgttgtcacaatccccatcttctaatctcaacttaccttcatctggttgactcttcatccctatatatgactacgatacccggttacacacatcactatcacctgtcttacgcttctatacaacagcactttacactccacgataaataaagctgatgatgcaacatggacgtggctatttgaatcaggacattaacagctttcaaacgataccatctttgccaactgtagtatccacctccgttcctctgggctctggacaagttgtctggctccctccagtatgtactgtacacccatcttgctccacagccaaacaaaaactagccaaaacacggaggaaaatcaatcagccagctccaactagaaaaatatgtggtcatgtgacactttctttggatcttctagctagtacaagtactgtcctggctttgtatctctcctgccctcaacatcgccactgaacgttgtatgtacgtctcagatgcaggtcactgcacgatgttggaaaaaagttgactacaattctgctctccacacaacagcaaaaagaccatgttacgggtgctgaatggcgttcggagtgtcgttagggggcttcatggccctctacaaactcctagtaatgttactcggccgtcaaaattccgcttaacgggctatacaagtctccagcgttttgccagcaccatcacaacagcagacaagttattacgccgtggcgacttcaatccgtcgaatctagcatctctatcgcctcgagaggccttcacacacacacccattttctaccccgacgaagtgaagtcgttttacgacagtattgagttccagggtctggaagaggaattcctggataggatccgagaagaacctgacatttccaaacgactaggaaaactgatggcctttctacggaaccagattatccagggccacgcagtacaggagagccatcttctggagtggttcaaaaaatacgtgcgaatcgaagacggaaagatcaagcctctgtattcgaaaggaaacaatgatctgcaagagagtgaggtgcgggagctgctgaaccatgtggtcaatcgaacccagaagccttcggtcgagtttctcaagtggttggctcaggaagactccattttgtgtgagcatcatttgtttcgatcgtatatcaaggatctgttgatttctcgaggtttctctgttgagcgtcggggcaagatcgatctgcgacaccccgaggagctgtatcccgatgctcgaatgatcactcgaaagatcatctgccatctgggtcccactaacagtggtaagacataccgagcccttgagcgtctgaagaaggccaaaagcggctattatgctggtcctttacgattgctagcccgtgagacctacgacagaattaaggacgagggtctgcccatcaacttgaagacaggagaggaggttatcaactgtgaagatgagtttggacggcctgctcctctgacagctggaaccatcgagatgatcgacacgaaccagctcatggaggtgtgtgtgattgacgaaattcagatgctcaacgaccagtctcgaggatgggcctggttgaacgctgtgcttggagttcaggctaaggaagtgcatctgtgtggagaagagagtgtggtcaacatgattgagaagattgtggcaaagactggagacacgctggaaatcaacagatacgagcgactgggcactcttgagatggaaaggcgacctctcaagagtcttaaagaagtcagagcaggagactgtgtggttgccttctcgagaaagaaggtgtttgagttccgacaggaaatcgaggccactacaggcaagaaatgttccatcatctatggagctctgcccccggagacccgagtcacacaaagtagagacttcaactctggtgtcaacgaggtgctcgtggccactgacgccgtgggaatgggtctcaacctgtccatcaaccgaatcatttttgctgctattcgcaagtacgacggactcggagacttcaatcttctggaacctccgcaaaccaaacagattgcaggtagagccggccgatacaaggtgccagggagtgacaaggttggcagtgtgggtctggtgacctccatgtctaaccagcagtctaagtacgttgccgagtgtctggcagcacccactatcatgctatctacgctttatgtgaaaccccatgatgatctgtttgctcctctcgtgtctggtgtcaagggactggctaaacttatggctaggatgaaccagctcacagatctgtctgttgactaccgactgccttcgtttgaatcccagctggagctctcagaggcgtgcttccagggtctgtctcttgaccaggccctcaacatttccggactgccgtttggaaacgcaaagtactgtgaagcccaggttctggctatgacacgagccatggctctcgggacggtgtacactactgcccagctcgctctgccagctcttcaggaatacttcctggctccggtggctgtcgaacgactgaagatcatggaagacttgcataaaatgatctccgcctaccgatggctccagaaccgctacccccagacgtttgtggacattgagggagtcaccaacctgcgtctgcaggtcgaagaggtcatcaacagtattctccagagctctcccaagaagggctccaagaagagatgattgtatataccatgaggaatttagtggaggattatgtatatagcgcgctatcgtagcaattattatttaattacaagtacaagaacaattggtatctttgaatgtaacacgataatatcacacacccttcggagtggtaaatacagtacagtctacgataacatggtttcatctcataatcataatctatcaataatttacatcagtttacagtgtgcgtgttagcgttggtttatgcgtcatgggccagtccggctgaagccccaccaaagaaacgacctacgactgccagaagtcgcacccgggcgggaacttgccattatatgtggcgggagcggacttgagtgggtaaaacaggtcattgtccatatccatgtggctcatgtggccaaggtcgacccggggagtgggagtttccgacttggtgggcatcattcgacctccgggggtaccagggtgattgttccacgacgagtccgtgagagtacgagtcatgggaggagcagcctcaaagggcgcgtccagcacgtcgtacgacatacccacagccgacatggaccgagtcatagggtaatagtaatccgacgacgaacccacgccctggccaggggtagccggagtgggaataggggccgccacagggatggacgaggcagagttgggaggtccctgcacaccaccctgagcgcttgtggaaccaacgctctgtacgccctgaggcagcgaggaaccgggcgaaacatcagagacgggagaatccataccacctacccgtcggaacaccacctgggcactaaaggcatcctcagcctttgcaaattcccacagaagcacaccgtgaggacggctctggatctcgtcggtgcaggagacgtcgaactgagcagcatcaccgggcagacagtatatgacctgttgcatggtgatgccaccgatggcagcggtggctacctcctggctggaagtggtggagctgtcactgataccagcgacaaaggcagaccagaaatcgccagccatgggcaacaacaaccgctccttgggtgtgccactgttgtcgtgctggggagctgcgggcaccaggtttcggagctgcagaatctcgtggcccagcgtccacacccgggtctcgcacatccaaaaccgcgatgaaggaggagtctcgaaatgtggcggcgacaccacaaactgactctgggtcttgagctcgggagtgttgccagtggaggaagagtgctcagggaggtacagagcggccttggcgtggatgacgggcacgccggtctgtgcaaagtacatcgagtcagggaactgctgctgcacggtggccaatcccttgggtctcagaggagtggacattggctgtcgcatcgactggcagtacacgtggggagcctcgtcctcatgccacagacaaaagtggtggggagagaagctgggggtggggggcgacatgaagagaggtcgaccgggtccaccactgtgcatgccgtgtgagccaccagaggaacctcccagcactgcaggcgaagaagggggtcgctggatggcgtatccgagctgtctgtggcttcggggagtagagtgacatgcgggaggaggcgagatggtgttgggttgctgctgctgctgggaaacaggctgggccagaggcttggcggtggttcgaatcaccttctcggaaacaacaatatcgccattggggttggagccctcatccccaagcagcagcgacatgaaatgcttgtcgtccttgagcaggttcttgaggacctgaatgtgcgacgaaacctgctttcgagttcgttgcttgccagtcttcttaaaaatgtactcggaaatgagctcgtttcggccgcaagttcgtccgttgatgacaatctttcgacgaccaacacaagggatcactttgagcgcctccatgaaggcctgctcgacgtcggtggaccagatggaagggttcacgtcgcctcgctccttcttctgccgcttcaggtactttgtgtaagcctcccagttggtgagagcgggcatggaagtgggggactggttggcgtcgtcggttttagagtcggggctggacgaggccgagttggtctgcgagttggagtgcgaattggagcctgagaggtcctcctcgaccttgacactgggcgatccgggcacggtggggagcatggaccggaaggaagtgtctgtgaaggggtccgacttgagcggcgtggcgggctcggacttgaccggtgcagcgggcaccacgtcgagcttgaactcagcgtacatgggcttgttgttgtgagtattagtgtgttgctgttgttggagctgctggtgctgttgaggttctgcgtcctggaacgaaaactggcccgaagggaaggccgagttgacggggaaggaggagaaggagtcgacgcacgagttggcccgtcgcatgccgggatgctggggcatcatgccgccgttgttgttgccgttgttgttgccgttgttgttgctgctactgcagtggttgagagtgacgttggggcctccgtccacacggcctcgtttgatacgttccgagtccggaggagtattgagcgcaaatgccgatggcagcaagtcggagccattggcagacgtggggcaggcaatggcgatgctgtggcttcgttttaacggcgttactggttgtgtcagcatgttgtgtgtatggttgtggtgttacaaagagtgtgcctggttgcgggtgtggttttttgtctctcttggttgtgtctgtgtggctgtgctttgtgtatatagcctgacggtttgcgatggagcgagattgaaacgctgagggtgtcctgagttcttgtctgtgtaacgaatgagtgtgagggtcctctcgatgactgaatttcaccacttttgcagctctcaacttttatgagggaagacaccaagggcaccctcagacacttataccaaagccaactaagggatgacccaggtgcatgactgtgcgtctattggaaatagagttgctaaggggtggcgggccggtcgagatgcgtgttttgtggtgctgatagtggtgctattcgcgatatgaacgtgtcaaaatactcggctagacgtgctcttgaagccagtgtttttgaatcctgaaaatagccattacctcatctctcgacacgaccccactccaaacacgactctggaaacccacgcgaaaataaaagcctattttcaaaccttattattattgctcggacattggggcgttgaaccactaaggagacgtgatctctcggtggatatcgtgtatatcggcgtttctcattggtattcgtcaattgttgtccacatcggactcataggcgcgagtcggtgtctttttcacgctccacgcgtccacgcgcgtgtccagggttcccgcacaaacctccaaaaactaaaactcagagtttgctaatcaagggagcggaagacatctgatccgatgtatggagggtaagacgatgggaggggggttggtttggttatgtgattggagaaccgcattcgcaccaacttcctgtctccacaaatcctcctattttcttgtacgagcatctctgaatgctacgagtacggtacgtgcactcgaagttcaccactcgcacttcaacttttcatctctctctctctctttccaacttccgaaaggatagacttcgactcggctgcgggagcagctcaatcaatccagtaaacgacctggaaaatcatggtctgtgtttgcatcttggagtttctgatagcatgatagcgtttggttcgagctctacgagtacagaagaaggtactggagctactggtacggtagtgtactcgagctcatacccagttccccgactccaaacacaccactctatacccccgtgaccagccccgacgccatagcggctcttgtacactcataactgacgtttagacctttttgagcccagccattatttttagtgcaatcggatattatcacctccgcgccgcagctcaaccttgtttgcaagcgaggtacagcgtttcataataacatcacatcgactgatggaaggtccacagaagaattgtgggccagtggacttggataattaatatctttggtcatgtccaaaaagggtctctgtggcaactatcaccctgtggtcctctcgactgtgatattgttgtacatctgaaacatggccgtgtgtaccctacactatactcgttcaagtgctcgtacaaccatgtcgtttcagagccacatttgagtcttttttttcccccgtgacgccatgtctcccccacccgatcgcgccgctcaaatcggccatcacgtgaccggatccggggactggctggatttctctccatctgttattgctccatcgccaaaaggtttgaacgctacgcccaatagcgttccaatagcgttccgaaacgcgctccgtcacgcccccaaacgcgtgcagtatagttgcctcagtacagcgtcggtcacgtgagcggagaccgacagaaagaaaggacacaaacaaggggtgaatgtgcatcgagcgaaacaggagggtaatcttttgctccaagggcgagcaaggagagagaaaagcaacgactcagatatggatatgatatgtctaactttttgcactgtagagcactgtataatgcgatattaaacgggatggaacggggtggaacggcgctgacgagtacgagtatataattagaaccgtactgtacttgctttcaccagccctgataatatctccgtgaacgacaggcgatgatattatattatatatgtatatatatatatatatatacattcagcacgaatatggtaataattgaccagcccgatgttgtaagtgcgagtatacactctggtagttgtgcaagtacaatacgagggcgagtatacatactggtagaggtacgtacgatacagtctcagtctcggtttcttgattttctcagtttttggtacagtactggtaattactcatattgatactgtactcctccgtcacctgtaacatcttgtcatctacaatacggaagaccatgataaagtgcaccccttttctccttgactgtggctatgatacaagtacagaatgacatgactcgtagtcaacctatatacgatgtaaaatagttgtttgcacaaccatctccacgtccgcctccaatgtggggcgcattatcttatgacaaaagtcgttgttcgcccatgtctagaaccaatctgacttctccttgtctcctcttgttctcaccactcgatcaacagggcatatgcagatacaggggtatccgcatgagggaggtagtggttcacggcgccagacgcgtaccacacgtatcaaagtacaaggagcactacaaagtagtccgtgcgcgtgagttggcggtgcgagtactgtagtcgtgttctcgtgcctggtttgatagacgcgttgccgctgcagttatagtcaagcctgtgcggaacagtgtacatgtactgttttgtgaattggtcaatttggcccggtatttccacatttccacattgtgagacacaacagagcgattattgcgaccatagctcatgctcgcccccaatcccgccatttatttcccctccatgccccattacccttggttgtcgcctccgagatcaatcgcatttagagctctgagcctggtggtgctagagctaggggagtctcgagtctgagacgcgccatgttgggagctccgacgtgtaaaagcattcgtatgagcaaaagcaccggtgtgtaatgaatcacgtgaatagccgccgtttctgattgctgaaacgagtacctggtgcaatggtgttcgtactggtactgcttgtagtatcgtagttcatacattgacaaccaacttcaagagcgcgtcggacgcaatgcctacttgtagttccatgcattgcagttacgtgtaacgctctcaatgcgttagctacttgttgcggcatgcgttagctacttgttgcggcatacgttagctacttgtcgcggcagtgcgagcgcaggtagtgtcggtacttgtgcaggttccgttgccgttggtgtttggttgtggagttgtggaggagggggaggttgatagagtagtcttcagtattttttttatagtaatagtacatacagtacatacagtacagacagtatatttttattttattttctgcatattttttagagtacatactgtatgtattaacaaacatatcaagtaaaagtgtctttagttgacacatttgtttaaaattgaccctcggagttgactctctaactcggtgaataatggtcagaatggcttgtaatttgaaacacggatttcttaccaccatgctatccgattaaacactctccattgttcattaagcctcccaggtccctttggagatgtccctggtggtggcaccgctgcacctacttgtagtccggacgaccgaatagcagaagggacaaattttagtcatttgtctcatttttcgaaaatggaaaaaaatggaagagacaacagaccctcatatattacacatttacatcattctacttgaagttgtacaagtatatcccatgtgtggattcaagtcaagccctttttttcctctcagattcccagattccctattatctatccttgtacgggctaaaggaagtgcatatacggggatgggcctgaagagtatccagaaacttgtctgaaggccaaaatgagaaataaaacatctcaaagcaaacaaccgagtcccataatccagtatataactggtgcctgaagaaattcccacgtttagtaccagttatacgtctcctcctttgtcgttatagagcaaccgagtctcaacctaaagtgtctatcttttggtgatgttgagctggtggagcaagtaacgggatacttgtagctatatatatatatatatatatatatatatatatataggagatatgagctgagaggtacttgtgaagataggagaccaatgtgactaaaagtacttgtaatcggaaagttgtcgttaccgacttttaacggatatactatatatatatatttctgcatattatattaggaaccacctccctctgttcgccactcaacccaactacagttacagtagccataaccacactgagcaacctactgtattctagcaagcacgagtatcagtatagtatcgtagcagtatagtacacagacccgttatttgtacgttgcaaaccacgacattggaacctgcgcggaagatagtcgccacctctccgctacttgtttttccatccaccaaaaaactgttctttctgtttcccccacaccagttgccatcgcccccacaaactctaaccgtcatcagcgtacataatctgcacccaatctgtgtcggcaactgtctcatcttgttaccatttcaaccgctacccaccatgttaacgacgctcaaaaacatcaaaaagacgtcgtcattcaccgcgcgaatggccccggacgctctattccccacgctccagagcgtcaaagaggcacccgaagaattgctcagaaaagatcgatacctgaaatccggcaacttcacttgggtgtaccctgagcaacgccccgaatacaagatgctggccgtctcaccacccgcagtgcacgacattggcctggaggccgcggaggctacgtcagactacttcaaggacattgtgatgggcaagaagtacgtggaagacccgttcccgtacgcccaggcttacgccgggtggcaattcggcgaatgggccggccaattgggtgatggacgagccctgtcattgtttgagacccacaacccagtcacaggcaagcgctatgaactgcagctaaagggatcgggtctaactccatactcccgattcgcagacggaaaggctgttctacgatcttccattcgagagtttttaggatcagagtacgtcaacgccctgggaatccccacaactagagctctgtcactggccgagctgcctggcacgactgcccgaagaggacgaggtaaggaaccctgtgcagtgatttgtcggtttgccgagtcgtgggtccgagtcggtacctttgacctgctccgaaaccgaggcgaccgaccaggtgtaaaacaattggctgactacgtggtcgatgacgtttttggtggcgaagacaagctgctgaacaatgatcacactagagacgccattgccaagtctgccattccttacaaacacaacaaccgctacgtcaagctctaccgtgaaattgttactcgaaacgcgtacatgtgtgctctatggcaagtctttggctacctgaacggtgttgtgaactcagacaacacgtcagtctacggcctgacaattgactacggcccatatgcgttcatggatgcgtttgaccccaactacacgcctaaccatgacgacggcctacttcggtactcatacaagaatgttcccactgccgtctggtggaacatggtgcgtctcggagaagatctggcggagctgctgggtgtggctgagggcaccgatctcgagaacctcacaaagtcggagaagaacgagcttctggacactgccgaggctgttataacctcggccggtgaagagtacaaggctgtgttcctgtacacatacaagaagtttatctccaagcggtatgggcttctggagcagcgtgactccgactttgatgagctcatgacccctaccctgaatatgctcgaggattctgctctggactaccatcgattcttccgactattgggcgacctgcctttcttcacaggtgagaacgcctccaagtccgagccagccgactttgctcccgacgtggagcagttcatcagccctgaaaagaacatcaatgctatcaagactccatctcagactcgaactgagctatcacagttcctagccgacttcaagaagcgtcttgcggctgaaaacaacacggacgatgctgcacgaaaggtgcggtcacgtgagattaacccaaagtttgttcttcgttcgtgggtgatgcaggaggtagttgaggatgctcacaagggcgactacgacaagctggagcgggtgctgaacatggcattgcatcctttccaggagacctgggacgaggactgggatgacgaggaggcccggttctgcggccatgttcccaagtactgtgattccattcagcagacttgcagtagttagagataaccgggttgggtatatcttaataagaaaacatatcacgataatgtactgtatagttgtcacgtgagcgatcgcgtaggaataaattacatgtacatatactagttaggctgcgtggtcgagttttgggaaagcaccttcagctctcaacacgactgtgtgtcgttctcgagaaatatagcccttaagtcgatcgtgatagatcatgttggaaacggtagcctccaaaaagtcaggcgatacatcaacgccaaccagtttggcagcagcctggtagtcgtcaatggtgattcgtgtggccttatccttggcaagaaacacccggtagaagagcttttcaaacacaaagacccgcatcttctccactgccagatacaagtacttcttcacgaacagggaccttctttgagtcacagctttatcgaacgacagcacgtcgcctcgtagtagagccgtgagcatctgatggtagacggtatgtagtctaggaaacttttcccacactgccttggaaggtacctggttggtcatgagaaactgtactgggatgagatgtaacagaatgagctcctggttatctgtggatttgtaaaagcactggttgagtgcctgggtgagccagttttgcgcctgttcgacatcatcatccatcagacttaagactcctcgatagtacgagtaagtgcaggtgtgagatctggggtaggaggccaagggaggtagatcacgagacatggattccaccaccttgatgaccgacttgctcatatttcgttttctgagcaaaaagtatagcttgcagagctcgccaacaaagaagtaggttccccattttttcgatttctgcaagctgggatgccggtcgttcagacacagtgtaagggttcggttgaccactcgtgacgatgattccagttgtgtgagaatctcgttttttgcctccttgtcctggatctccttcagcgctcttcgtccgatacctcgaagatgtgtgcttgctgcgtacagtataggtaggatccacacatcttccttctcagaaactcgattgagctcggacaaaaacgcctggtgagcctgtagtcgctccagtggagtcgaggaatcgttgcaggccaggacgtgcgcctcgacaactggctgccatacctggtttgtgattcctgccgccacggcgagggcgtttgtttgcggggcagtgggatttgtgtctggattgacggccaggaggtgcgccaattgcagtccgttgcgtgagttgatggcggcgttcaaatttcgcacgtaggtcgccattttgacgatgctgtgacgttgtcgtagcagtcaatgtgcgtagcagacagatgtaggtgtaataaaattaaggtttctatactttgttggcatttgttaaggggtaaacagtttagttgagatgttcttgtagcgttcgaaacgagctagtaagactgtaaaagggcagaaaaaagatacggaaacatgatatatgatgatgctaacagtaatcggcagacggtatgtctctgtctagaatattaccgtttctacgagcttggcacctcaaaccaccttgatctggtgatgctggacatttctcccatttttcgccaaatagcatttctgagggaattatcaaacccgcacagtcttagcgatcaaaatttatacccattttgtccccttagcatctccgtcccattattcatcgccatcctcctctcaaacatcccactcagcgtaggtcacgtgcgataaattaagctctacatgcatatgagaaaaatatatttttcttccgggaagaaaagataacggacggactcatacaagataccacagtacaacgcaacaccatgggactggctggagtgtcgaagaagatcaaatacggcaaggacccgcgaaacctcgggtggtccaacaacacggagcggttcggccacaaacacatgagtaagctcggatggaaggacggagagggtctgggccatgaggaccgaaaggcgcagagtatcacgcaaaacatcaagattgtgctcaaggacgacaacgtggggcttggtgccggtctggccaaggctgataaggacgaggcctttggtctgatggatttccagaagctgctgggtaagctgaacggacgggctcaggaaattgaagctgaggttgagcgacagcagaaggacgttctacgaggcaagtttggcatggtttttgtgtccggcggtcttctccagggaacgatcgaggagttcaacaagaagcgagggtccgaggctgtggaggagtctgacagtgattctgaagagtccgaaagcgagtctgacgacgacaagaagagcagaaagagcagcaagaaggaaaagaaggataagaagagcaaaaagcgaaaggctgatgatgactctgatgaggaggagaagaagagcaagaagagcaagaaggacaagaaggaaaagaaggaaaagaaggaaaagaaggaaaagaaggaaaagaaggaaaagaaggaaaagaaagagaaaaaggataagaaagagaaaaaggataagaaagagaaaaaggacaaaaagtccgagtctcctactcctcacgatggtatggagaaaccctctgcatcttccacctctgctctacgaggacgaatggctggacgagccaagttcattcgatccaagcgaatggccgtcatggacgaaaagagtctcaacgagattttcatggtcaagaactgatccaaccaaaaatatagatgctaactgattgagagtgaacgtgcataagatgggaagagggtagttcgatgagaggcgtagtttgtttacatacccaaaattgaatactaattgatacagctatgaaaaattcatgagtcagatcaaagtcctaattttattattttaattcagactatttttctgttaaatcacacaaaatcggctcaaaatatttttaatggaaatcaaatctaaatttaaataaagttgaagcttgaggaatttaattgtggtaatttggcataaattctcccaatcgggaaaatcccaatcaggaaggtgattgctgattaagcaatgtgagatacaagtaaatgagggaaaatgaccatagtacgatgaatattagtattgcaggcataatcaaaaagaaccatatataatggaaggaagagaacatttgaacattactattgatgagatatactttacaattgtcccgaaaagtgaaaattacaatcattttattgaaaagctcgggcagttggttttgaataaaaaagcacgagatgaaattttctaaacaacatgatctgataagacacccatacgatatctaaagcatgaaattattttttttgtgcaaaccaccgagttctgattttggtgttagtgtccgaattgcgacgtaatagcatggtcaacaaaataattctctacctctgatttgtacaaacaaaacttctcaaaagtatgtcgagttctattcttgtgtcatgagagccggtcacattttatcttcataattccatgagaaatgcagttcaaaaaaaaaaaaaaaatcaacatcttcggtcgctaaactaacgaaagatgattgatattattttttcataccccttcagatatgacaaaaaacacctcattcagttacggtgttcgtagaagaactcatctgttcgaatattggtcaagatcgactacatactatacagtatgtacttacaagatgcggtcttgttatcaatttagcacagtcgcttagataattaaaaatgagataatttgagtcctaaatagcagcattagagatctataattatcaaaaatcactctctggtcggtaccaggaggtattttttattacaatgtaggtcggttcgaaaggccattatactatgggatattttggtatgaagacaaaagtcgaagagaagtccattaataaagacgagtatcactctgacattcatttacactacttctaaaagggctaccacgtgtcgtaatatgtaatggggctatgccaacaagatctcaagaggaacgcttccatcacgggagagaagacacacagaagttcataaatctgataaatatcgctcaaacatcttctagacacctccacgtctctgtttaaggtctatgtcgttcctcaacgggtcatattcgtgctcttgttgtctgagtaggaagatgaatgaaccaggaatgaaggagtaggcgtactttacgcagctcatttattaacattccacagtttctgtaagaacttgtgacttcctagcaacctgaaagacgtaatgatggttccctgtcgtagtatcagtctatgtggaatgcgctgttactgccttatgtagtctgtgggcttctagagagaaatactaatcgaatcagattcgaggaaaaatcacggacgggcccgttttttatgagattactgccgtgaacaagtgacagtagagtacatacagtacagtagctctacatagaacaaaatccatatcatctgggaagaagatacgacattagagtgtcaagaaacgtctatggaattgtcaccaaacctgggaaccctagtcacctcacctgaagtttcagagtgttctgagtattttcagtgtcggggatacttagtatggcgtacttctggaagtgtggacaacgacgtcggaaagagtgccggtagttacatgagatacggtgatgttctgaaggacacccatgtggctagaagggtctttgtgatgtccagaagtgccagtatagtgatcgaaagtaccagtatcgtgatcgggaagttcccaagagtctagagcaccaaaaggaaagctggtgaaatttgctcaatgactgttgaaacaatatctatctctacgagcgtcttgagaagtcaacagagaatattccagctttgatattattcagatcgggcgtttattgactgaaataaaaacgtctatcggtaaaaatcagtatttactgtgccagagaacattgacagacagttgttcctcatggctattgagttgattaaaaaaagattcggtgtttcctggcgatatcactttgctgtttgtttcgagtcaaggaccaatactgactttatggtcccctttctttccgccctccatggaatttcagacaccgctggaagttccaaataaattcaatggaagcaataaatatccaccgatactgaatttccatctgttaatatctttcaaagtatttatcatgctttttttgagctcacggcgttcgttttcaatgttggattggttggattctgatgctcttgtaaacatctcaaacaaaagcccaagaatattcccaggacactattacaagcttgaaaccattaaaatagttctatcattgcatttaataagttgcttcgtggatttgagagcctcttttggtttgtgtgatttggagttatgtaaaattgagatggagtgatcgataattgagtatataaacttttcaatatcaacaatgaaaatttcccgatccggtaatatattactgatcttaagggaaaaaactaggaaaattcaacttttatagtccataattatcttatattgctatataattccctaatatatatactgtacgactattttcaaagtaccaagcagcccccactgctggtacttcgaaaatagtccaaagtttatgactagtggctgccgacactaacagcccccactgttgatgtttcgacgctagtcatgggtttggtctcatcagggcagccagtcccccgttgtgcttgacgcgcaaataaaaaattagtggaaaatccactgagcccacaccgcaataatccgacaccccacaacacaactgacattgtgttttgtacactgaaaaagagccgtcaccgcaaaagagccaacatcccaacaagagccaacaccgcaaaaagagccatcaccgcaaatagagccaacacccgaaagaaaaaaaagagcactggggggcacccgagacttacttgcatcactggaaagaagcgtcagaccttgaccacgtgaggctggggggcgtggtcgaagggtaacaaaagtggcatctctgcgagattccggtttccggaggtccagcagaatccaccgcctcgagcaatcttctgtaaaggaaattgagacactagagggatggggacaccccttcccaatcgagtctcacgacgtttcttcctattcaaaactgccagaagaagctgagacgacctgatccgtggtaggctccaaggaacggacacgaggctgctctatagggccttgagaggaactttccaccactccaacgctgcatcacctcctttccggccctggctctgtaacctccttacagagtgggtcctccaccggcactatgtgccaaatggaggggaaccaaagctacctcccgctgtgttagtatcgctctagagttttcaaaggcttacgtggaatcagcacatgtctctttgactgctcacttgaagtgacacagaaacaaagagctagatattgtgaaaacttaccgaaaaccccacctgaaatgaatggagaggactgagtcgatgcccgttcatctagtcgtagaagatgtgtcgtaatatagtcgtagaagtgtcgtgaatgatgtagtagatgatgtcgtcaagtgaggagagatgaggaagaagaatagaatgtcacaaacatcttcagaataagctaagatgggaatgtatacagacattgtggtataatgttgtggctcttcatcttaatttgtatgtattgttagtcgttttaccgtaataggaaaaatatataaaatatacacgatgcatcttcccaggatgtaatcccttaacctatatatattgtatatatttattgtatagaatagatgtcacaaatatcaaaaattaaagttgagataatgcaatggagtgcataattgaaactttgtgaatgtgggcgatgagctgttgataattgaatttcattcctgctgatgggaaattaatatttgctgaatctccaatggcgctcttgtgagttttgacaactaaaatttcaatttgcagcaactttttgagggtttgaggaaattagtatgttgttgttttttttggtttttttttactacgcgacctgatgctgagttatcattgcaaaaaccaaaaaatcaaagaaacaatgtgatacttgtacttttacttgtaccaaaactcatattatccagtactgtacttgtactggcttttcaaaaatgtacacaaaaaacaaacatccacaggtcggatcagttccattagacggttatcaatcaacttgggtatttacacgttgaaatccatctcgtaatgactaagaacagacccccgccgcaggcatggtcgtccgagatggtccatgaccaaatcgaagttcgacaccatccagagagctttattctgctgcaggagctccaagataatgaccgtgtcagagctttcttcctcgcactgatcgatgtgtgaattggcaccaactccagatgtacgagtagtcgtgttgtgactgttggtggtttggaggtctggaggaaccatataggctggttgtgtggtatggaagtaaatactgttgtaccttgtttccaagttataggacaggataaaaaggtgttagttggcattgggatcagagcgtatccattatctgataccatcgccagctctcatggcccttgttccataaactactgccacctaactccatcccgcaagtataactctggtcaataagcatttcgaagagttcattacgtcttagacgtgggtcatagatgattgaccttaggtctaaaaagcagctgctccgcattgtgaccattacgacatctgatacttggaaaacaagatgcagtagcatttatacaatacagtgcaacgctttgggttattaacaaacggctcttgtgcttcaagacaatcaatacattaattatatatcccaccccacacaaccccaacatccccatagaatgtcctatccctctcccagcattctctccaccacccctggaggatgtgattgagaagaccacgcaacccaaggttcgaacactttctccctcgcacacggaggtgaacgagaacgagggttccagtgcttttcccctcacacacgggtgtgattaagaaggccaaacaaccagagggttcaagtgctttctccctcacacactccaaccatccacaatccacggcatacggcctcccaccatccctcatcttccactgctcctcaccttccaactcccctcgtcttccagccctcgtcaccttccaccgcccctcatctgccatccaccacccccttccaactcccctcatctaccatccaccaaccaccacccctcactctccccacacctcctgtctttcaaacaagcccccaaatccactccgaccttccaccaccaagagcaccaacgtctatgctccaacatcaccagtgccaaaattatcatcgatagcaagtaaaaaagtaaatctcacgaaccggttccgccaagaacgtgagtgacgctagtctggtttcgtctctgtgcaatcagactcccctcttgggacgcgaagggtgattgcaagttggtttgaaactgactgggttgtagcgtcgtgtctaaagacgaaaatcgtcagtagacacgggttttccggggcactccctatgagactctgtccctgagttcatagcatgcttggaacctgggtatggttaacgcacaccctccctgtaaacaaagtaaattcctccctgggattgagatgcccccctggagactctggcctgactggtgcctatccgacaccctcggatgacgcagtcgtttggctcatagctcttcgggaagcacccgtctatgactagctctacctatggtagtaactagatcgtaggacgcccatctgtgttagtaagttgaaaaaatgtggtggagaagacatggcaactgtggggactcctcttgtagttgagacacttggttggacggcgatcaaggtgctggaaacatagatacctgtagtgtgttgtttgcctgtgtcgtttttgtgtcgtttttgtgtcgtttttgtgtcgtttttgtgtcgtttttgtgtcgcgtttgtgtcacttagtgtcgtgtttgtgtcacatggcttggttgtgggtatcagtcgtcgaaaagcgtggtcggtgatcgagacagtgtctgtagttgcagtgtcatggacctatgtaatgaaatcaaggtatcccatgacgttgtgtgatgtcgtgtgtcgagctgtttgtgtcacaaacacccgatttgcgccacaacggtgccaaaaagtccccagtggtgccagtcgaacggaagaaagcataaatactcactcaagccgcctctttcttagccggcgacaaaaagaagccgtctttttcagtgttcgagacgaaacacgtacttggcggattcttggcgatgatggttaacatgaatagaggattctggagaatctagaaattgggggtatatttatattacacaaacagacaattaagctatagctaacatgcgaccttaaattatggcctgatttttacgtgcggggatcgtatcaagatggattatataaaaccgcgaattcgactccattcaactccaacttcgacgatatcgtttttttgggttcgaagtagtgcatactaaagttttcatctcattagtccctgcattatcaacgctaacatcagaaatatatctctggtgttgttttatgcccgatgaaataagcttcgtgaaaatggcctgattatctgttaaaagtggcctgattatcttgcaagtttatggcaccgcaagcttatggcacaccttttaaggttactcaacaatttgtttatagcttaaatgttctcaacagatttcttggaaaagatcatatattggtcgtacatctactaatattcaactaaatctatatataattatttcagcatgagagcatgtcattgtttttgtgttccgtatccttcatataagatttaacggaaatctcaaggtgtctcattaattactcactctacttaacagttttcagctggtttttgttggtaatcttaattctacatccccactgtaaataacggtggaaaaggtcaggtgagtgttgttgagtttttgcgagtctgggatgaggtacaaatagctgtgggggttcttccagtaaataccttctttaacgacaggttttttttttttttttttgaggggaaaacgaaaaaaaaaaaaaaaaaggacttgtatgagcacagtatatacattacactcgtatcctgagtctgtgacgtcctactcaagggatagtcgtcttgaaacgagttcttttcacaaatccctgaatttgacacattccgctagtgatgctacagacgaggagctgtttgcacattactattgccactacagtacatactgtaccagtagaaaggtattcctccaacacatgttttcatcactagtcatggtcaaaacacgaaagggaagaagcggaggcgatcttcgcagcaccacttctacagggccagtgttgaggtcatcaggaccggctcgacctacaaagcagccagtgaaaatggggtattcctgtgtccatcatttcatcaatgttcgtggaaatgcgtctcgactgtcgccaacggttgagagtcagctaccaggaagcagcatttacttcacacttgtgtcacgtcaacaagaaaagactcgcagaaagctcgagaaagaattgactagtttttgttaagcaaatggcatcaattaaccaacctgttaagttgatgaacatcatttggaacgtctaccgcttgcttggatcatacagctaaggggagaagcaagatgtgggcctccgactggttcgtcgtcacgtcaccgacttggttggtcatcagcaactactcgtggtcgataaaggcctttctttgaaagggacaagataagatggcccaagaaccgaagccccagcgagctcattgtaaccatctccgacgacgacctgaaacacatgcttcctgacaacaggtggacaatgaacgagacggggatcttcagattggggagaggtggaacggagtttgcgattgtctcctcgttttctatcgacatggttgatgtgtctgatatctgtatcaatttggacgagagaaaaggaaaagagtgacgacggacggaaaagaccaacgacggaaaagaccgacgacggtgacaacattgtggataaccaactgagatacatttaccaacaaatggcagaatagacatttcatttgttccaagtcttccccacatgcccagatgttctcaatgttttaatgagattaacgccacctcgacctcaataagctgttgcagagaaatgtaacgcattttctttgagcgactgttgaagttgacgtgagattgccaccgtatcaatacagacgtcgagaaagtagccagaagactacttttaccgttagagatttaacgaagaatatatattcttatatattccaattcaagtaccatattctgtacatatttttattttttttctgcttatgaagtctgctgagattgtatatcccacctgtaagtccagtatggttagatttttcagttggtaaaaatgtgttaagaaatgtgttttgaaatttgtttgtagtaagaaataaatgttgttgtagacatcatagatatcagctctaatttgtggcatgaaatggttatcattctgctttggaattctctcttgacttatctttcattttcaataaatcttcaaaaaaaaaaaaaaaaaaaaaaaaaaaaaaacctgaatctgcagcttggggaaattttagtgtatcatagaagggagaattgccccgatggaagggtaaaatgaataatttctgaaaaacaaataggtgattgattattgatgaccatgcttgggatacgtttggggttttttagatctatatttcgtttctgtcttgcatagcaagcattattagcgattttcatcgcggtgttgtcagaaagagcaatgtgatctagagaagcatgaaaaaacaatcaatggttacggtgacatggattattacaattgaggactatagatccaagtttggaattgatatataactttttttcacaattgtactagttctgtaacataggtacactctatgtatcatcctttggtatagagatcatacctagaggctctggactcagtaaatatctccaatgccatccaccgagggactcaagaagttgttttttgacatctttgacaagcaggattcccggctcctggatagtatctataacattggccgaatcaaggcttggagcgatggcaaaaagcgtaaggagcatcatctctggtttagagggaggaactataacatagaatgacaatttaccgatggctagcatctctatggaaggttcatgggacaaatttggtgtttatatgactcaaaaatggttccacccatcttcttaaatgctaccaagacagttcttcctgttctttacattacaagtgctgtagatcaagtacagacccgaataaagcagtcgtctacttctattagacactcacttggtctaatagcaacaaatagtacatactgatgcgcgcttttacacctgctctttgaatacatggctcatggcgactctgaccatcggaactttcaacagtcccggggatatatacaactgagattatcgataatgctgataaattattatgctgataagttcatcgccattgtttggaatctgcctacagtagagtatgtactggtacctcaatcccatgtccgaagtagacctggggatttgcacctttcctagaacatcttcgatatgaaagggagcgaggagaacttgaaataggaccagtgacggagcagcttcttgtagaattgcaacatctattgattctctctctcctcgaacaatcatggatatctgtcatgctccacagatcagcaatttttcgaccagactcttggataagtgacaacggtcctctaaaacatcaatcatgtgttctgattccatctcagtacttgtatcaagtgcataggccaactcctcattattttttcaattttttattttttattttttattttttatttttttatttttttatttagtttagatggacatactgcctgagtagttttatacaacacaactcggtatcaactaacagccaacaattgacaattcgcctagtaactaacagccagggtctcacaaagctccctaactaacactatcaccgataaacctctgtttcgaccgaatttatttatcgcgcgcgcggcgttggacttcaaaagtttgcccgatgtctccgattctgcacgagagaaggcaatcattttgttggcatttccagaatttcgggataaattcaagaaaattcaaataattggactaaaaccggaatcgtggaccatactcatctcatctacactacactataggttaacatctattcggcaaagccattatatacatattcttgttaggggagtgtcagtgatcatctctggtcaggacttagaaccaccagctccaccacttttgccgctggctgggagagacgccaaactgacccacaggcttcttcttgccaatgttgaagccccatcgcttgagaatcttgacaacagagggggtgatggcagcagtgatgggcagtcggatgaaaatcagagacttgtggatcgcataagcaacagcaaactcggcccacatctgcttggaaaaccagtacgactcggtgggagaggtctccggcagcttctcgtccaccttctggtcctcgacagcagccccgatatcgggagtcaccatggcaagagcgccggtcacagtgttggcaatgtcgctgccctcaacattgtcctcctgaagttcctccttgggggtggtcttccatccaaccaactccttgaggtatacctgccactccaccaccttgtcgagacccacagagtgaactccgagccagcagatgggcagatcgatggtggaaagagacagatagactcccaatgccacccagccgtacttttggaccagagccttgattccggtggccttcttcttgttgccctccttgccttccttgtcgccaccctggtcctcctgctgaccctcagccttggaattgatgttggtgacattgttggcgttgccaggctgtcctacacttctctccatcgtctggggggtgcccgaaaaccatctcacagacgaaagtcgcgatggagcacagacgggtgtggggaaagcgaatcgggtgacgtgagcgggtccacggaccccggcgacccgcgaaacgtgcaaaagaccccgggaaattcctcgaatgttcatttttttttcaaaatttgtcgtcaatagtcggccgaaacacaatgagatgcagctcaacatgtgcctgcacagacagtgaagcacgttagagtttttctgattacgtaaggtggcgatgatccccagaaccagaaggtactgtacttgtagatgtaaacttgtagatgtgaacacaatgtatacgatattggtggctacatgtggtgttgattcacgtgacgttatttttgaaaattctctgtctattagattctactcaggactcttgtccagttaatagggaagatcttgaagaatacagccatgtttgtccctgtttcattccttggattcattcttccgctgacctcttcctccttatctacttgtcttatctccgtatcaatcatccatcataattcattagttataggtgcccctatttcgtcatctgtcttcagacatcttctgtcatcctgcgtcgtctgccgtcgtctgctgtcgtcctcaattgatctccgctccgtcacctccatcacctcagaatacacagccatccgagagacacaaaaaagagtccaacggggtaggcagccagaacggttcgtccagggagaacacccgagtgtttgagcgagttgttggccgaccacagcgcccaggccacgttcagaacgatcacgggcacagacagccagatccagggaatgaatatctcaaccaccgatcccagaaccacggggaacagcgaatagcccacaatgcacaagcctcggaaaaaagaaatgtttcctccaagcaacttgatattgagagttacgagaatctggcccatccacgtgatggcaaagactccggaaaacgcctcgctgttgccccagcccaagctgagagccagaatcaaacagaacacaagaggaccccacatgtcccactccttgatcaattgagaagagttgtcgatggggttgataaagccggaaagggagccgggccacaccacctccttgagccggtttcctaccccccgcacgtctcggccaagagttcgaagcacaggctcgtctaaagtatctccgcccatgaatcgtcgggtgaccagctgctcgctccccacagacgtggtgttttggctgttgctgggggcgggagtgtcctcctcgatgatgaagtcgtcgtccacgtccaaaagatcgttgttggcctgctgatacgacattttttttgcggtatttggtgatgatgttgcaatgtgtgcagatgatagagataggtggccaacctaattaaaaaactgacatcgacaagaatcgaactgggcatatgcgtaaaccttaaatgaccggaacggggcaaaaaatggaccagtccggagtcgaaccggagaccttccgtatgcgaaacggacgcgatagccactacactacaagccccaattgtgcctcaaaagactaaatcttcaatatactcatatttattattacgtaatattgtttttttcaggtttaaaatcaagagttttgggggtatttctacatatatagagtctataggctcttcataaaacaaatacgttcaatttctaaaagatatgacatatattgagtggttttgaaggcttttataatgtagtttttatgcttgctatatgagctctccatatggaacattgtgcgatgacaaaatgaccaaaccagaacgagtgtggcatttcgacgagagagagaaaagttagccacttcctcattactctttgatccactaatacaagtacaagtatagtacgtacgtacttgtactagtagccggacttcaagcagcaaacgtgccaactatgaacgccctaggctttgcggttactgtcatgaaggcatcaattattaattatgggcttgtatgtctgatctcatcattatttgctacctaatagacacatgaatggtgtctgcgtcgctctcggtgaacaaactgcttctatcagtatctcctctgaagagcgaagagctagcatctgtatcatacaccaaacttggtggaatggttgaggtggtggttgaggtgatgaccgagtgtctgtcattgtcatcgtacggtttctggaacttgtagcattccgtagaccagtatccgaaccatccacaaggtccggctcctttcttgttcacttcttcccatcccatgtcctgtatccattgttctagcggtcctttggagctcagcttcaagtctgtgatgatgatatagcctcctggtttgcacacacgtgccatttctcttagtatctgtctctgggtcaccttatcgtatgatttgaacgcccatggagaagtcaccaaggaaaagacgtcagattcgtacggtaactgggtgagatccgccgagttgagcgttaccaagtcaacaaaattctcacatcggatgttgttgatgattttcttcatgcgcgatttacgctccttgtccctcgaatagttgtcaatagcatatacgttgcaaaccagctgatttttgtcctttcgagcgcgtttctgagcacacactttcatcagagacactcccgagcctgacgccacatccaacgtggggctgtcaaagtcatagggctcttcttccaacagttgctgccagagatcgtgccgtcccttgtaatttgcatacatgaaagcccctgcggagtcgccggagaatatggcgcgagttttcgactcaaagtgaaacttggtcgacagtttctctccactggcccttggctccaccttgatggtctgaaacgatgtccttccttgatctaggtgtctgtaaaccatggttgagatcgaaatgttgatgggtgaaaaaaatcagcaaaatccaggagaaatcgaaaaaattggtggaaaaaaaacagcacgtcctagcggatgctgtagatagtcaatgaactgatcggtctcaaagatatcttatcgtgagagtcccgtcgctaatcggggtttttagtcgctaatcgaaagtgtagatgaatcagtgcatggacgcgcatacacaacgttgggtatgggttagggtagatccgaagcggattttgaagcggctgagaaatcgctgggtggcgacccggagctgcatgtgaggcgtttcgagagttgggaacgtttcagggatgttcaaatgctggtctgattctggcaaactttttttcggcatgtttttgaccctctttgtttccattagacagctcctatgataagtccgggttttgcttagtcataatggaggtgaacgctcctgcatgagtgcatatgtgcatgtgcatgttcagtgcatgttggtgttgggtggtcggaaaaatggtgtggaaaaatggtgctgaaaaaaccgattgaagggtgttgtgtgtggtggaataggattgaagggtttcaatacgatgacgttattataattgtgttttttggtctagtacaagtacgtgtacgaatacttgcagcttcagccgtagcacaataattcagtaaatgtccagaacgtaatattgaagaacaattgagcacacctttgaaggatggtgatagcgaccgagtaactaatatttttaatatttaccattctaccgatggagatgagataacttgattgaatcttcctagatttttttcgattttttttcgatttctgtatgattcaaataaattaattagaataaacacggcgaagtcccgcaatattgcccttattcgcgcaaataatggattggatgccatgatatattgcttccgatagattgctcctgacacatttgtgcatcgaagggcccacggcccacaatccaacttgtcgcaagttggtttgatcgtgtgacgttcatttattattgctgagctatatcttcgacctgacaggcagagttaggagtaatcgtaaaaggggggcaccaatacgagtactgggctgtactaaaaacagcactctgacaatactctaacatcagcaacaattaatcaacaccgtcttacatcagatcagcaacaattacccatttcatcttagtcagcaattggggcccccactccaatgaacgcccacttaggacttctccatttgcctatgcaatgtgaggcaaaagttgaaggcaacccgtttggtgcccgtcttgggttcggctccacttcgcggctgaagactaacaaaattatgtctattgagatcaacgttcgcggggttctaattatcacatgctgccattcgcctgcttgtagctagtgctattcatgcctattatcgacccgaccgcggaagaatgtgaccaaaaccgcgcccagcggactttttatgggcaaaaatcggcttctcgggttcaattctcggaacccgcattcggctgcaggaggtgccaggtacgcagcaggacgcgagatacaaccacgatcatccactacaactacaactacaactactcccactcgtagtgtagaccggagcaagttacacagacagaatcagattgtatatagccgaaatacgtcaacacccccccttcccccatctatacataccggtttgagcactcctcaaataacagagttacggtcccagttccaccaccaacttgtcaactccaactccagtctcagtcgcacacaaaccaccgcttaaagccgctatagccgacaggacacaaaccgaccgcggcccccatagcgctatatcacgtgaccagcaccgaagcccgccccttcgcccttccgcccgatctccgccgccacgtgttcttgtgttttcagcggggcttccagcgggtgctttttcccacaccaccaccacacaccactacgctccaactccccccttaaagtttacgacacgtaaaaattgcctctacgcatcacctggtacgtgacagtctcttactcccccacaccacaccaccgttgttacaatggcctgcgaaacacagctgctggaaaaggagtttggtcgactaacgtcgccggagtacaagtacaagcagaaggtgcagcccagcgaaaaaatccgccatgtcgaagaagaggagccggcctactacatgctgctgctcacctacctggggtatctgattatgattgtgtgtggccacgtgcaggactactacgccaaggtgttccatcccgagacggtggcagacttcatggccaaggacggctatgcgccgctgttttccgactttgagtccttctacatccgacgtctgcagaagcgactgcgagactgtttcggccgagtggtcacgggcgtccccggacgatacatcaccgtgctggaccgagtctctaacgactacaacaccacctacaagtacctgggcacctccaccgactgtctcaacctgtcgtcgtacaactaccttggatttgcccagtcctcaggccagtgcacagacgcagccgaggttagcatcaacacagagggaatctcgtcctttggcacccgagccgtctgcggcactctggacgcacacgtcaagaccgaaaagcgtgttgccgagtttctgggtaaggaggacgctctcgtctactccatgggctacggcaccaacgcctcggtcttctcgtcgctcgtcgacaagcactgtctagtgctctctgacgcgctcaaccacggatccattcgatacggcgcccgtctctctggtgccgtcattaaaatcttcaaacacaatgacaccaaggacctggaacgagtcctgcgagaacagatttcgcaaggccagcccaagacccaccgaccctggaaaaagattctcgttgccgtcgagggtctgtactccatggagggaaccatgaccgatctgcccaccatgtgcgatctacgagacaaatacaagttctacctgtttgtggacgaagcacactccatcggagctctgggaccgcgaggcagaggtatctgcgactacctggccgtcgaccccgcacgtgtggacatcctcatgggcaccttcaccaagtcgtttggcgccacaggaggttacattgcgtcgtcgcacgagctaatcaaccacctgcgggtcaacaacatgggcaacgtgtacgcagagtccgtgtcaccacccgttctcgcacagatcacagctgccctgcagacgattgacggcgagattcggcctggtgagggagaggagcgtctggaacgtatcgcattcaactcgcggtatctccgtctggcgctcaagcggctcggtttcattgtctacggcattgacgactcgcccatcattccggtgctcctgtacgtgccggccaaaatgcctgaaatgggccgaattctgttgaagatgggcattgccgtggtggtggtgggttaccctgcaacagacattgcgtcgtcacgggcccggttttgcatgagtgccgcgctgaccaaggaagatctggaccgaatcattaaggtcatgtggcagctcggcaacattctgtccttcaagtatggcaagggaatgcctgatgccaacggcaaggtgcgacattgggagctcagcgaggttttggcctcgggcgtggaggactgtaagaaggattggtaagatatagtaaatgtgcatatagttggcagtaataatacgtgtgcatgtgtatgatttgaaggggggggggggggggggaccatttctgggggcccattaaaatctgagtaacatctgactgagctttatatgctttatttcttcaggtgctacccagaaccagagacaccctgaaacggttgacctctgtcagttagtcagcattttcttcgcatcagaatcggcggcatggagcccactgatgttagattgcatgtacatactgtaccgggcaccgttctccgcggcgttcatcaccatgtccttagtaatcattgtcagaggcgattatcttgggttggcggggctgtctctattgagccatgggtcgtatctgtcatgcggttggtgcaaagatatggaggtagtgatgatgacggttttttttatatatattttttatatttatttgcacgatactttttattttattttatactggccagcacaatagttgaactttatcaagtatttcggcaagtgggtttatggtgctacttgaactgtagttgagatggtcagacaagaccatgggttcgggtttcacaatgacacgagccgatgggagatttgagcccccgaatgtgaagatttattcagagccagccgagccgaagtacaagcacagcacagtacctccttgaaagctagcttacaaaggttcgtctgtttcacctcgtcaggggtagttgagaatgagtacatactactagattgaattttgatctcgcgataatggactcaatattgaagccagcgcaaaattaatagcatgagtgagaagaagagaccgaggggataaatttgatacaaaaaacttcttcaatatccgctatttagatccaccaaaggccatcactatgaagcagcgggcacactgtttcaaccaagtttgttggagaaaaggttcgattatagatagctccttgagtggtctaaatatgatatggattagtgaaagtcgttgttttttgcacgaaaccgcggagaagaataaaaggagccatatattgttcattaaatgaaaaaatattaataaaaaaattaaaaaatgccctccctattgattccagagacattctcgggtgactgtcaactgcattcttgctggaactttgaagttagaggttggagggaaaaatgggtacaaaatcgaataaattcgagaaaaataaataaaaaaatataaaagccaataaatatcctctataacatatattcacagactttgccacaaatttgttgaaggaaattcaacaacatgtcctagaaacccatcctaaatatagaactgcatgtacgagtatttggatgtacaagtacactttcatacatacatctcagctctgtacaaatcatacagcctgaatagcagacacgagggattataacaatctcttttgttgaagaagcgcgagaggtatattattactaagccattattttccgacgagccccttactaatcacaaatatctgatttgttactgcccgtcaccacatatataacggacacgtttatgcattatcagatctggggtaataatgtgcgacatggcatacagttttataaagtgagtttttgtgctagtgacacaaatgtggttgggaacttatatatagagacagttattcccgtcatcgttatgtcttctgctgtgcactacgccgctttgtcccctcaccgagggtgtggtttgtcattgtcacctcaacttcgtgatgatgtgtcgcactgtgccacacaaggcggagctaaacctaataaccatggccaaccacacacaaaccaccacttccagctcaaccgcacaccagttgtacccatgcgatacaccaatctagaagagctggggaaggccgcgaggcaggcaacaggggccgtgtcgggcttcaagcccaagcgcatggtcgatctggcactatctcagatagagcagtacaagcagatgttggagatggacctggagctggcagcctaccacatattccaggcccgcgagattctgtttgtgtgcatccctcgccacccggactacgataaattccaggccaagaagggccctttccacgagacgtacgtggagctgtgtgacctggccgaaaccgacagacgggtgctggagctcatctccactgtcaagggcaagtatgtgcgggaaaagacatcgggtgtgcgacgacagtccaacgacgacctgctgcaatccatcgacgacactatacgaggcttttcgcatctcgacgtccaacaacagtctgccccccccacagagactgatccactcaaagacaagctggagaaactgcgtggtaggagccccgaggtgcagcgggctacattgacgaccaacggcagcagcaccaccaccacgaaaaacggtgtcatgcccccaccgaagatatcgccaccgcccgttccagtgccgcaaaacggaggctacgtacgacagtcatatgtgggccctgcatctgtgccctccccaccgccccattcagtgactccgcccacaccgccacgtcacactatcacgctcaaggcgccgcagctgatctcgtaccttggacacgctcccgagactctgctgctgctcgacattagaccccgagcagacttccagaaatgccatattgccgctcccaacgttgtgtgtgtggaaccgcacctgctggaagcagacatgacagatgagcaagtggaggagaaaatgctggctgcactgacgacggaggagtttgagcggttcatggcccgatcggcgtttgaaatcgttgtcttctacgaccagaacagtacaagctaccagacccgtccgctgaaaattctgctcaaggcgctctacagccaggcgttcaagcggcctcttcaacgccctccatgtctgctggttggaggtctggacgagtggagacactcaggagctgccacatctttcattgacacccggtcccctctacagcaaagggcagagctggcacgaacacaaacggatcctacccccgtggcgtcctacgaccccaacagagtctattcgcacccctacgccagcaactacgccagctatgcgtactcatatggtcctaaccagtcatccccaactccccctccagtaccaaccaccccgcctccgaaacccccctctgcaatgtcgtcttcgtcgtcgctcaacctcccacaatcaatggccctatcttcatccacgtcgttgccggatcccagctcgtacaaaaatcaaatgtactcatgtcatccgtatctcaacgagcccctaccggagtccaggcaccacacacacggcgtatctcagcccgcccaggctgcccggtcttcgcatggctattactcccatgctcttcctcagttgtcggtgaatacggcctcttcaccgatcaaacagccgcccagtgcttattcgccaaaagaaaaacacaatggcgagttccccagttacaagagtgtgcgccagcctatcccacagtcgccgtacctgccccatcttgcacccatgtccggatcgcctccccccatgtctctgacctttaccacaggtctcaagaacctcggaaacacctgctatatcaactgcatcatccagtgtcttgccacatcgcagctgaccaagatcattgtgaatcaggcatacaagcatcgagtcaacatgaagtcaaagctgggatacaagggagctttgattgccaagtatgctgatctcgtgcaggctctagtggcgaacgcttacccttacttggtccccacttccttcaaaggaatcattgcacatgtcaactctcagttcagcggcatggagcagcatgactgtcaggaatttttgactttcattcttgatggcctgcatgaggagctcaactctgtgggcgatggtcaatacaagccccgtgagctgaccgagagcgaggagaagcgacgagaggagatgagtgttcgaattgtgtcatctctggagtgggagcggtacctcaagtccgcgtcttcgtttattgtcgacgaatttcagggccagtaccaatcaaagctccagtgtactgtgtgcaaaatgacgtcgacgacatacactgcattctcgtcgctaactctgcccatccccaagtacgctggggccactctcccaacgctgtacgactgcttcaaccagtttacgcagccggagttgctggagggcgaaaacatgtggcagtgccctacgtgcaagaagccgcggcccactatcaagtctatgaagatctcgcggcttccagaaactttgatcatccatctcaagcggttcgaccactcacggggctatggagacaagctcaacacgtttgttacgtaccctctggagatggatctcacgcggtattggcctccgcccacatcggaggacgagcccttcttgaagaagctgcttcctcgtggccagacggctcctttccggtactcactgtttggagtggccaaccattacggaacgctgcgcgggggtcattacacgtcgttctgcaagcgtggcaagctcggatggtgctactttgacgatacggtggtgaacagaaacgtgaacgagcgagccgttgttaacaagaatgcgtatgtgttgttctaccagcgccggcacaatccttagacttctcagagacacggtaggcgatatacaatgaggggacgaaaagcatcttgaaaaatatgcatatagctatttatataacgaattatgattgcatgataacatggctttggtggagggcaggtgtgtacatcacactggttgttgtaagtttagttatgtacttgatggttgattacgcctatgactgtctcacctctatagttcggagatacggagtcttggaagtgatgttttcaacaaggtctgactattgattgattattacgtgccaggtactaaaagaaaacgtgagcaattcttggcatttttctattagtaatatttttccattagtaataataaatatcaagcgatcaaccaaagtattttggtcgttttgtttcagataagtgttgatgtagcactgcaacaagctacaaccatgagtgaacagtatgtactggatgtaagagtattagtatgagtacattgtatatggatggtggggtgaagaggagattgttttattagcacaacccttaagcgtacagtatccgttccccgactgggcgtagctatactatttttatttttgtttttatttttatttttatttttattatttttatattatttatattatttatattattattattattattattatttttttattattttttattattttttattatttttttattatttttttattattttttatgctcttttttcttctctttttctgctctttttctgctcttttttaccctttttcagctgtttttctgcccttttttactctatttgaacatctccgacatttcgcggcctggaaataaagttgtccaggctggctagatggagatagcaattcggaggtgggatgggaggtgagctggagctcggtgttgagataagaaagtgtatagaagggcgtgtttgagacgcaattagtaagagagagacccaattgagctatttggggtgtactggtcgcattgtcacatccatctggccatgtcagcctacaaaacaacggttttttgcaggctcgtcgagggtggctgactaataaactcccgcatacagcgctctcgacagtgcatgacatccaccctccatccacaccactgagcgaatatgagcgaacaaccaattgtgctagatcaaggaaccggctttgtgaaaatcggctacggaggcaccaacttccccgaacacaccttcccgtcgatggtgggtcggcccattctgcgggctgaagagcgggccacagacacatacggcgacgtggccatcaaggacattatgtgtggagacgaggctgccgcggcacgaaacatgctgcagatctcgtacccgatggagaacggagtgattcgaaactgggaagacatgggtcacctgtggaaccactcgttttacgacaagatgaagattgacacccggggtcgaaaggtgctgctcacagagcctcccatgaaccccctcaagaaccgggaaaagatgtgcgagatcatgtttgagcactacggcttcaatggcgtttatgtagccatccaggccgtcctggctctgtacgcacagggcctgtcgtcaggagtggtggtggactctggagacggtgttacccacgtggtgcctgtctacgagtctgtggtgctcaaccacctgacccgtcgtctggacgtcgctggtcgagatgtcacccgacagctgattgctctgctactgcgacgaggatacgccttcaaccgaactgccgacttcgagaccgtgcgacagatcaaggagaagttctgctacgtctcctacgacctggacctcgacacaaagctcgccaacgaaaccactgctctggtcgacacctacgaacttcctgacggccgaaccatcaagctgggatcagagcgattcgaggcccccgagtgtctgttccagccccatctggtcgactcggaacagcctggaatcgccgagacgctgttcaacactatccaggccgccgacattgatgtgcgatcgtcgctgtacaaagccattgtgttgtctggaggttcgtccatgtatcccggtctgccatcccgaatggagaaggagctcaagcagctgtggctcacccgggtgcttaacggcgaccccacccgactcaacaacttcaaggtcaaaattgaggacccccctcgacgacgacatatggtcttcctgggaggtgccgtgcttgctaacattatgcatgacaaggagcacatgtggatctccaaacaagagtgggaggagcagggccccgcatgcctggccaagcttggtcccagataagcggcaactccagctacaaccctgcattgacagtatcaacctaacactgtcgatgaaggaactatgtatgttatatgatgaaacgattgacgaactgtactagctgtgtagcagcgagtgcagtggatgtagcagcagagctacagagcgcccaacttgccgcgagtcttattgtacgattagtgtaggctgtcagatgggcatttgcaagtattaactgttatctgtggatatattgttgattgtcagtgcactgtatgccatgtcaaattgctaattaatcatttgtgcgtgatcaactgacccttcaccttcacagatcacatcgtcacttctctcgtcttcattccaaatgggatgcagagttatgacgctgcttccaactattcagtggaccgcaatactccaccactcgtagctatttctcagttccgcacttgtccatccttctctactcaactcataaaatcgtattatctattcattaatcattatatcgcctttggcaaggactaggcccactttccgatgagggacatacaaatcatgcctccaaccagacccgacattgcgaaaaagactcgctttttgggtgcaaaagaaagatctccaaacagccagtcgaacgccaacatctccacaactccagcccaaatgagcacgccagcagacagagccgagatggttccaatggcccaaatggtggcagggtcgttggagttcatggagtccatgacaccgagaccaatagccatgccgatgggagtgatgatggtgaaataggtgcacatgctcattttgaagaacagagacgagtcacgaagtccggcgattcgagacccaaggccgataccttcgaacgcctggtggaacagaatggcgatgaacagagaaatgaagccgtcatcgtcggcaattgtgactgcaacgccgacaagaacagaatggaaaatgatgcctccctccatgataatgacggagatcttatcgttaggatcaatcagagtggcgttgtgagcagcacagcccatgttggcggctccagacatgtcgatctgggtttcaattacgtccacggcacccttgacctggtccttgtcgcaatcgtccgattcactggagtggttgggcttctttcgctcatgacgggctcggagccatctggcagagccgtattcaagcacaaaggcaatgaaagtaccagccaacgcaagagacatggcagtgggatcgtagctaaggtctccaagacactcgttggtgaagtcctcctgactctcagctgccagatgcacatatgcggtactcagaaccactccagttccaaactgcttgacgaaggtcatggggagcgactggaggttgattttgaacacagaggtggccaaaacgggagggaaaacaccaagggccgaggtggccagaacggcaaaaagagcgccgattcgaatgggctttttgagatctcgaggctcgaaggaacagtccaattcctcgtcgctgtttcttccggctccggagaagctcgaagaagcctcggaccgggcctcgagttgttttccaagcagaacattgttgagagaagctgccaacacatcgatgttcttgttgttgaactcagtcagacaagctcgcttgtttccggcgccgtcaacggcacacaagagtcgggttcggtcaaccttgagaatctctcgaacttgcaacgactcactggagttgatcagaggctcgatggagtgcacgttgatgggtgagaaggccacagccgctgaagccaacatcgtggagcagatgaggtttgacagcttcatttttttcgcctttgttttttcttgagtgtcgtagatcttcagatcgttatacagagatcagatagatagtgaccggatgcttgttatatatatgttgcgattgagcaatttcatatcagatgtattctacaaaagcgaaagaaaaaaaataatccaaagaaatcgcaaaatggagctgaaagatctcgtcttctttgtcctcgccggggtctcttgacttcggggtaacagcctccttttcttggaacaaccttaattgtacttggaattagttgaccctaatactggacccgattagagtgtcgtaaaagaatatagactactgtacaaggtagccgaggctgaaaacaacagattcaagaaccggtacgagagaaacctatgacttatctcaaatgagtcattttagaaatacttctaggccattctccgacacggtgcccgaaataacccccaaggtggctgttgtctgctcatttactatgcatgatcacgtataagtgagcagattggaaaagagacctcagagagtgtcagatttggaggaaggaagaatgggacatcaacccagatttatgagtggatttgggctatagaaaagaattcgacagggtaatgtgaactttttgataccaataactaccagaatccatcactcgtaacatctccaaaatgccccttgattctttgctctctatgcacatgcatgcgagcctattttcgcactagccacaacgccacaccttcaccagccacagttatcgtcatctcgtgcgtgtctgagatgattttgataacagagccccggatggaaacctgctttctttgtctttctcaaacattcggcgtagcgcgcgcttgtcatttgtgtccgtagctctgttccattttgattgttcctccatagccagtccgtgcctgtaacctgtgtgcctggggtcgtattccttccggaggtgagcggcttctttcttggctttcaacatgttgagtacgtccaaggagtgagtatgatgcaggagccagggcagtggtcagaatctttgacaagacagagcgggtatggtcagctgtagagagcattgtgtatggctaacaaatactgcgcttgtaccaacccgtattgactatgagaacacgctaggaggttatttcacagctgacagctgacacactccacctttgatcgtctgtctcatcaaaggtgggcatgtctcaccactctttgttcaccaagtccagggacagtacattcgtacgtgcaatcccggtagattgataaaagatttatcggcatggcgaagatggaaggtgcgtgtagatagttacgggtattgtatcggatgtagatagatctcgtctggttgtagatgggatgacatttaattctgggtgttttgtgtgtgtccaacaaacgaccttcaaggtctgtccatctcaagcttcaggatcaatcatcatgctcatttttttgagcagataaagaagggtgaaaaattagatgcccagacttcacattggacagagatgagcaaatatagccggggtgtatgacaccaatgaaagatcgtcttggctttcagatttcattgagactatctctgctccttgacggaggatacggcatcttcacattctcgtgccaagagccaagagccaagagtcgagattcgataaccgggctaaaggagccacagtgaagagttttttcgtgaataaggcattgccaaagtacgttcatgacggtgtcactagttcacgtttgacgatacattcatcacacccaagattgctcttcaagataactgcacataggtccaaagttggataaaagagaagtggatgattgaaaagataggaaaatgaagaatggttaatgaggtggaaatactatcacaattcagaatagtagcgtgaattacatgatgcagtacgactaaacatacagtatgtaatatcgtggcggcctccggacttgcacccatactacagcgcttcaagaggtgactagatcgctcatggaaaagtagatcgcctacggaaaagtatatcgcttatggaaaagatatttcgagtctttgatcatgtgactgctgatgctctccaggtttggtacctggtacgtacaagtgagtatacatacctgaagcttgcgacacctggtcggcagagttattgaaacctttgtagccaatcagacacttgtttgtatagaatctcagaatgaaaagcagagtgaactaattgaccaaaccgaaccgctcatttagatcttttagaatgaagtcatctgttgaagttggtgttctgagggtgtttcggtgatgtgagttcacccagtgtactgtgaatatatccgcgcggctaacaaatataagtcttccaacgattcgataggtttttctgacgactccctcattttaaaccaaagcggttttcgcgaattttcgtttttcatgcctcttagagccagttgaccgggaacaccaccggtataccaccaattttcaggaagaggtttacgatcaacaggcaaaatgaaattcgaaatacccgacttattcccgttccactgaggagcattttcttattgttttttgcaacgttcatcatcatcactgccttgatcgcttttttttattttttttatttttttttctttttcacatctcaactttgaaacctaaaaatagctcgcttctgcattatcttgaacttaataccccacatttggagaaggcggaaatggcggtaaaaacgaccattattggtactgctaggatcatgtgttaatatagagattaactagctctgtagattctacaggtgcatctatttgttttaccgatgactcagctcaaacaaacggtagccgagccgagccgaggtccaaaatattgcaggagcggcccagtagctaactgaagatatgccatttgacgttctttgaattgttgctgactttggaaaataaacaactgttggagtctgttgttgatgcagagtgtgatacaaatagctctcgcccaataagttctggagtctcgaaagacatacaccatagtccagggtctggcttaggagctctggcttagataccaatcaccaagcgctctggacagacagtcaagagacatactgtgagccaatcgtggacaaacatgtggatctcccatctgtggatcatgtcatctgatcgtgtcaccggtggatctggtgcttactgtactacaagtagtctcggacatctcaagcacactttcagctcattgccattaatacagataagaagtgatactacacgtacatcacatggtacagaaacccacacctctacaatgccatctccccatctccaaagctaggcatacgttgactttcaactctgtaagccgcactggcaccttcacgcataccagtgttctctcctattgtaagacccatgtgtcagttcatcaaagtctgcaggtggacatgattgtttccaggtccaaccgcttcgacatgcaataaatatatacattaaatgcccaaccaatgcttcattctctcgtagacaaagaacgaacatgcgaccattggagtcacctttatatatccaatagtgagtcccacaaaaaaacccttgaagccgctttccttgtaaattgtcagtgcggtcgccactatgctgggatgcactcctgatgagcccgcctgtgcgcctgcgacctgcatacgtcgtcgaatcacctcgaacggatacgatgcagtttgcgacaccattccggccactcctccggcaatgagttgtgcccacgccttgaggggctctcttttgtatgacaccttcttgtcttcgtcctcatggtgatggccctccagcatgacatcgtcattgttggtttccagtagatgcggataagtctttttcggcgcaatctcgcccttgacggtccatgatcggaagtaccgtgtgtggaacaggtcgtggatgtagtcgtgggtcagaaacgagacgcctgcgtatgggatcatacccataatcgtgggggtgaagcctcggtaaaagttggtccaggcagctattctgggcgagaagaattgggtggcctttgccgacggagtctcggcgtagatggaccgagccgctgccagtagccggcctccgtggggctttccaacctcgttagtggcatacgccatgcgaactcgaatcaactcgagaggataagtgcagtagacagacacgattccggacagagagccggctgccattcgtcgcagagccacctcctggtcgggaccggaaatcaaaagcgcccgaaactgctcataggccacaaacttgactgcagcatagggaaagattcgcagcagcgtcgccgagtggccctggaacaaaccccacacgccctgttggctgtaaatgaactttcctgcgcgccagaagcccagaaacgagccacgatacttgcggaactcgggattcgacgtctggaacagaatcttgactcgatccagcggagcgatcacagtcttagcaacacatccagccatgcctcctgccaaaccgcttttgcacacgtacgccaaagtgcgtttattttcgtacgtcccgtgagccgacatttcgaagatggggggattcagaaggagagtcggtcttcacaagtgtcgcgtggtgggtggtgaagtgagtgtagtgcgtggtgtagttgtgaaaaatgaactcttgccgagagtaatagggataaagttgtttaacctccgtccattcaccgatgtggggtagtgggatgagccctaaccctgggatgattggtgggggggttggggacagcaacagtccgggggggttttattatattgcctgcagatatctgcttgtatgaccgtatcacgcgacttgcttactaacccacttatatcgctctcctcaaaagacaattcccactcatctcattggtcaccaaccttgttgttgtatgggatgtggttcaaataaggtttcggtggaggaattcgtagcaggagattggtgagtgtgtggagatatatatggggggttttgagattagcaatcaattctccaggtgatgtagattcttgcagtaccactttcatttccatagccctactacaacaccgtctacacgtagccctaattttcaacggcgcacgctaaaaccgccgctaacaaaatctggggatcatgtgaatggtaattcggctacaatacagtatacttagtaatgagagacttcatgtagctccaggaaaccggtcacgtgaaggaaataagcagaaggtgaatggagttgggggttccaggggcgtgttgcgggtttgtattacgggactctctccaaggacgactgacgtctgaatcactgagggttctggttgctccgaaaaccgtccttagccgagtcaactggacgttggtttcagctcatggcatggtttggaagcagccaaaaaaaggaattataccatgagaaaaagtaattgcgagtcgaatgcggcgattggaatcgtctcagatagtatgaacacgggtacagtacgtaatgtatgatagtctgaatctgtggtgggtaaggtgcggaacttctcagagacaatccgttcataagatctgaatgacaatataagttgtggaatcgaaagagtaatatgcaattgagactgtcgtagctaactgatatataacatcatcattgtcattgtccatactgcacagctggctatgtacaagtacatacacacagtgtactgttgcatcttctactgggctattaatgaccatatgaccatacggatatggtagattgtagttcaaaaatagttttcagttgtacttagtaaccatatattgtcaaattccgagtaattcaccattaatcactggggatagccgttcttcaagacagtaccaaacgtcgctgtgatttggtctagaccttcacaatctcggtatcttaaaaaattcaaattgcacttgatattaaatccattgctatctacaatgtacaattcccctatgatcaaaactggagcggttttttcatatataacattacagtgttttttttaacttgtaattttttttttacttgttttttttaacttgtatttttttttttacttgttttttttttattttttttttgttctagggaatactctacaacttctcgaggcctataaacaatggtataccagcacatcggtttcagattcaactgttctgaagagcacatgaccctcgtgttcgcttgtccacctgttcttccagttccatatcgaaatacggcgtttttttcggtgtgatgctccaaattcgagatcaaataccggtgtcctacccgggacacatcgagggcgtctggtgtagttggttatcacatgcgcttagcatgcgcgaggtccccggttcgattccggtgtcgtccattcttttttgcttctctcgtgatatattgtttctctactggttcctgggctgtcttcaccctggcgttatgatctgctgactcagcggtcgactctcgtttagtttaggctgtgtgatgtagtagtccttattgcgacgaattttgcagtgttgagataatattttccataatatcaaataattggagatcaaagatcccttcttcctttccatgaactcttaccgagttggttgtaagcacgatgttcgcagagaccattcccgtcgactcaggtaatcaaaatgggaccatgatgtggtcgagatgctcgctacagtctcgaaatgattaaataaaatgggtctcactatttactgcaaccattgctttccctcgcctactcctcatccttggggtctccgattccatcctcatgaatagcaaagacacacccgctttctggcagacagggcgagtcgtagatcttgcagattcgctgcactcctcggcccttcttgaagtagagccgggtggtggacgcatgagccacaatgtttcctccaatgggcttcttggggtccgggttgaacacagctccatccacctgggcaaccacctggttggtgatcaccactgcgatgccaaactcatcggcaaggcgttgcagggttcgcatgaacttggccacgtgggtctgacgggcagacagctctcctcgtcctgcgtaatctgttcggtagagcgccatgatggagtcgacaatgagacacgagaaccgcgacttggtcatcatgttggccgccatttgcagcagctgcatctgatggtccgagttgtgggctcgggcgtatgccacgttgtccagcacctcgtctccgttgagtccgtatcgccgggcaatctggtgcagacgttcgggacggaaagtgccctctgtgtcaatgtacagacacttcccctcgcctcctccctgatcgatgggaagctgacaggtgacggccagagtgtggcacagctgcgattttcccgttcggaactcaccaaacatctctgtgatggctccggtctcgataccgcctcccagtagagtatccagttgcgacgagcctgtggttagtgtgatgagtccagaacgggtctggtgcacgtctgaggcggtggtgaatcccaagggcaccagtttggacgcctctgatagcagcttgtcggccttggcctcactgatgcccttgatggtcagcaggtgttttttgggcgtgtacgccacactctccactgtgtagagtccaaactcgcccaggcggttgatatccgtctgggtgattccgttgacggccaggcgctcgatggggatggcgcccgctcgttcgatttcttcgtcggccatttgagggtgtgttttgcgaatgtcgcggcaagatccccaaaaaaaaaaaaagacgtgttgtgtcttgactagaaaggaagtctaatttactgaaagtggtggcgcgtgcgttttcgtgttgcaaagtatattgggtggcgtcaaaacagagcattcggacggcatccaaaaacgtcaaataacgggatagaaaaagctgactaatcacatagctgccagtaggggtatcctgagtctccttgaagcggatttccgcccatccccacctttagaggcttacaatcgagtctggcccgtggagaaccgcggtttacgtcgtcgttattaagctgtacgtcgacgtgcacattttatgcatggggtggatcaggcaccgctgaaccgagaattacgtttctcacgctgagattccctgaaggagatcatctcccacaatgtcatatctacgacggagacgatatccgcgacaggggaatcatgcgacgaggcttcctataccactgattcggaaccgcgaggggctggaaagagggtgagagaatataagaatcttactggcagacgacacattcccagcgacaggagacgctctcggaaacgtccgtactcggttcacgaaatggacgaatggttccccgaagctgcctgctaaatcaacattcctggtgctcgcaatgccgcaggcgacaaggaagttttaagacacctcaataaaacaggttatcacgcccaagcccttatgagaatgagcaaaacgcttgacgatatcaagggctgcagttttccatacctcgattacatgatcaggaccaagagtttttctgaagtggtcagcaatgcccaacttgataaacccttcgcaaaacggattggttgtgtgtgtatggaccgaatcttggaagttcagcacggttacaggtccatctataaaatgacaggagagatgccattggatttttggtttaccagggtactacaagactctcagttcgggctcatccagttcaagactcactcgaagatacggaggctgtgttgaaatcttgggctacgtttggaatgccttgtgatattccaattctacaatgctgataatacttggtgatactgaacttcgacaatgtcaactgggtggtagtcactgggtggtagtcaaatcaactgggtggtatggtcatctgggcgaaaagcagcctgtgactgcaaaaagggtggaccaacatatacggtaatgatgtgaggtattcagacggatccaacaaggtcacaccgacaatttatggcaataggcattgtcctaggtggtcttcatcgttccatcactcccccacaacgagaatgctcctcggggtcctgctgaacgtgtgaggcagaagtcaagaaggagtgcagggagcagtcatagagggttctggagcttcaggctgagctcaatgagcttgacaagcttagatatcagccccacaaggccgccccgagtggttcgacaatgaagcaggatagttacaggtacacaaaggactaaattccagatccaaggcagagcaagtgtacccggctgcaaggataaatggtaagctggagaaactaaagtatgccaggctcagtgagtgtagatcagagcgtcccatccagagtgaggttgttgagccttctgggggtcggcgtactttgttcagcagcgagcttcttgttccattgagcaacaagggggcagggcagaaactgtgagggtgctagaatcctcacttgctgaacaggagtttgccattgctgaaatcaaatatgagagactgtcatccatcagaaaacccacctggtatcctcagccaacttctcgatcctcaaagtgtcgagattctgcagagcgaattgaagcggcagacaattattctgatctcgataaatctcagaaagagctagcagccaaccggagcaagctgaaatcctgcgagatcgatcatgcagggattgacgagctaagggctcagggaggtcaccaagatgccattggagcgaatgcgactgtttgcatttgatcatttggataccccgagcctcatgggtccggatcgcaccatgaagttccgatactatcagcagagtagtgattggatggagctcgcaccaccgcaatggggtttctcatgatggacttcacaaaagatttcctccaccaacagagctgccattctgataaacaatgttcagtttcaccattgagtctggtttttgctggtcgaaccctggcttgaatgtgaaagatctaatgacattgttcttgactccgaactcacgcagcctcagcacgagttttccagcctgacaccattggttacattgcccaagttcaattgcctgttcaaatcatgtcacgatatgcctgccgatgtgattgccaactacttcgggcaccagttcgtcaaaccgaccgcaaacatccaaagacggaagggtcaggttccccctctaggtgtcaatcctgtgcaacagaacctgcaagcaaacgaaggatacagccggggcatgttctgggctgccattgaggttccagtcgtgtatgatgatggtgagccccttcgttatggtagacgctataccgtgagggtaggaggtttcgatcgtctacttctccccgtagaaccaaagacacagagcgtaaactgagtccaagagacgacagcgaccagttgtgagcgcagcgcaaggcaccgcatataactactactaaacgaaaacgcgttgataacagcgtggtagagctcaatgctgatccagaggatgaaagatctgttgaccttcaacctcagtcccagctgctgcgagatccaatagatgttgctgagatcctgtcgaaagtacactgacgtcgaggtgccgtgctcttgtcggcgacaccaatgttcctgacttgcccatgtcatcggaatctcagacgacctctgatgtcgatgtctcagtcgcgccattggaggaaaagacggtaatcccaactgtctatttcttatccctccctggaagacgatatggcctcaaacatacccagcaaaatacccagcaagaagctctgacccgacatcccgacagaaaagtgctgattgaaggcaattccctggttttcccttgcgagcaggacgctcagagcgcctggcttcatctcatcatcgaaaagagtagtgaagagcgcgcttgtaagcgacagcatgggagggcagtccagatgtcacagtcctaccaattagccatccactttgcttcatgtcagtttgcctattggtttgataactaattgttgcacgaccatatgagcatttctcgtagcaagtctcgagtcgtgagcgagttcatcgtgaaatctacttggttcctagcttcaagattaccccttccgatctgtagtagctaattaatgaaaaaaattccgttcctcgtctacagaatgtattttttgtgatttagtcatacttcttaactaatcatgcttccattaaacggtttaagcaaagtgctaagtagttatggttaaacaaagaaattaaaaaaaattaaaaaaagaaacatgatttacgggacattgtcgagagatactcctatccagaaaacaatatagtgcactcgtgtcaaatgttttattacagtattcgctgtaagaaaaaaaagatgtcatcatttgtttggaaaaaaatggtccctagcaggatcgaactgctgatcttcgcgttgcaaagaggctaatttcttattagcacgacgccttaaccaactgggccaagggaccggtgttgttgttgaaaaaaagacgctgtttgtccgtagcataattcgggttagtaagtattgcatatagctgtaatgaattattagaatgaaaaaaaaaaaataaataaataaattctacgatctttatgagaacaaactaaaccaacctcgagtctggataagacatggaacgattgatatgattacttgatctgttagccatgattcactaccacgataccacgacaaggacaagaacgagacgaagcgtctacaaaccaactgacatgcgcctcgcaccgcacaccgcaatccttcagaagtgtatgatttattgaacgccaataacccggcgtactacttgtaggtatatagctgtaatgaatcattagaataaaaataaaaaaaagctaatgaattattagaattgagaaatgaataaaataaagagaacaaaagaagaaggtttccttaaaagaataacaataatgataataagaatcattagaaaaaaaagaattattagaatgaggaaaaaaaggaaagagctgaagcgcatttccctagaataccaaaaaaaaaataataaaaaaaatacgagaaaaggtacagtaagttagttgatgtatcaggattcccaaatagcatgttttgatttgttttgcttataatctttagatatcatgatgacaggaaaaatgatagcgacccagtatgaaggaggcttctgcttggtagtgcaactggggcaggtttgtagtttcccatttcggacactaaattttatgacctcaagagcggtataaggagcaccttgatactgtcgatagatgatcctgtccgttcagcagcccattccaacctggttttgagtactgtaccgtacacctactctagtaaatatcacgtgccttaatacacgtgatatctcacatggtatattactaatacagtacttgtaccccagatatgattacgccatcgaaacagacaagttttattttgcctcatctcatttaacccaaactggaaaacaaaggaaagctacattgtagtcaagcgatgccagtacagtcctggttccagtgaaatggctgatatactttcaacgcaaatatttaatgcaataaattattactattatgaacagttattgtttatctggctttaccttccttgcgttgcggtggggcaacttgtcggtcttggtggcagacaccccatgaacgtcccgcatgtgtctgatatatccgtcctggcgctgcagcttgcggaagcagatttcgcactggatgggctggctttcgtgcagatgcttaatgtgacgcttctgctccgtgagagacacaaagccgaccacgccccaggcacactctggatgtggacacttgagtctgtggctgaggtcttggtgttcctggtccaagtgtttggcgaggtcagcaagattgttgaacttctccaagtgcttgaatttgccgcattccgaacacgaaagctttccacgtttcttcttctgtgcctcctcccacaaccctcggttcttgagttctgccacacagctatgagaaggcaagtgggaatgcggcgaagcggacaagaaagagtattgagcagaagaagaaggagcggacgaaagagaccggttcgtgggtgtgagtttggtgggtgcgagtttggtggattcatgatttgtaggagactggtgggtagattggggctgcacggtgtccctctttgtagttctgtgatggtaaatgacgtcggggcgaccgcctcgtgtatctctcgtgtaaatagcttcaggagaagactgaatagacccaggactgtaggtggaatcactgccgttgctgccgccgtaatcgctggatgcataaccgtttccatctgtatcggagaagccttcgatccggggcacaagatcgcccagaacagacgtcagagacggcagagtaggagaaggagtcggggaaggggtagaagaataaattccatctgaaacagaggcatttctgtaatattgataagagtcttctctgttgatggggggtagtgaaatgttggggtacgaccgggcgtacatttctcgcacgcgattgacggaacacatgtactcttcgacgtcattttcggtctcctcctccgaattggcttccacctcttcacttttttggtcgatagttgtgtctggagtggggaggatcagagatgtggtcctggtcatgttgggggatatgctgcgatgtagggtatccatgttttgggggctgatactgttgctgacaatgttgttgacaccgtatcgaccgtggctagtgctgtcgtttggttcgtgactgttgctggaagtcatgtggcgatcattggcaatattatttccggctttgccagaccctttataactgccacacgggcctgtgttctgggagatttgacctgaagcagccccaaccccttgtgtgctagttttagtggtcgcagcagcctctgtggaccgattcaggcgcaacatggccacgttggggttggtcacatggtcgggggagtaagagaggtcgaagaaacggccctcctctagaccggtccatgcaatggcggttttgggggtccatgggtaggaggtgaggacggaagttaacggcgagaaacacgaaaagtcaccaatgggcgaccgaatgacgttgatctgcaagtgggaattgaacatttcgcgttgtaaattgttgataaaagggctagaccgggtcatttaatactatttttccagccccaactccagatgcgtattccaaagagtctggatgtggagatattgagtttcgtatttaggttttgagtatgcataacgtttgtatttaaggttttacttctaaagtgatgcagaatgataggtagaaataacgggtcattgtgacttgttcaaagacatttttggatcgcgtgaaataaaagttgtttcaccggtatttacaatagcagggcctctattatttctctgactgcactcttacttggctgtttaggtcgtgattcctctctgccacaccaaacccaaaactgacgatgacttgctgacaaaactggtgcttcaaccatgcattggtcctccatatcgtagcgcccagttgagaaccaaggtcagatttgccccattcgactgcgttctaaggcatttgtgaaacacttcaggggtttgtggggttcgtgaggttggtgtggcctgctactaggtcttgggtatcattggaaaccggtaagagcagtaatacagtacgagtatagtacatacagtacatgtacagtacaggtatcacagctctgtactggaggttcatattggtcatcacttgatatacaccctattagatcaattttcttgtgtctaaaccctgataactcgttctggctcccgctatcactcttgcttttccatggatatctagttcacctcccgctatcactcttgcttttccatggatagtacgatcaggtgctgagacaataattatcaagacaagactagtctgaccactcaatatacatcgaaatatgtagaatcgtgtttcaggtcttacgcccagaatcttcaattctggtgacacattaagacgatcagacaatgcatgttgtgtattgtgtcattcgacgccctaagggatactaaataactacaaattagtgtgcatctagtaagcatcaatggattcttcgtttttgttccaatatttttattttttatttttatttttttatttttttattttttcattctagggaaatacattatttaattttttctaattctaatgattctttacagctatacatctacgttatagtaagccgggatattcttttatttcagtttctaagattagtcatcggaagacacatgtcagtggcctaaacaaaaaaaaattttgtcctaaaatggcatcctggccgagcggttaaggcgagagattagaaatctcttggggtttccccgcgtaggttcgaatcctgcggatgtcgccatctttttgcatttttgcctctctatcaaatagctgtcgtgcccggttatacagtatgtacagtaatgagtgtttctgcatctgtcttgctgaaggctgtactttaacagtacatacagtagcttctattttactatagcttggaatacagatcataacacaccaaatggagactcagaataccattcaacgttctggacgcggttcggaaccccgaaccgagacgaaaccacctctgaggcctccctaactagcaaccggtccgcgatacacgagcgcatggctgtaaatggatgttccgaaccgcccatgcaggtatgtggatcttgtactacaagtagtgcatcttgtgcctgtattatgtacaagtacttgtacaatggcgatacacaacaggaccgcctgagaatgtcacaaggacaaaagaatgagcaagaaccactgtgattcgggccgagcacacagaaatctcggtgcccaaacatttgagagacgtgcattcgtcattccgagacaacattacagctgatcaattgacttcatatacgacaaacctcaagtttattttatatctctcacagcaatcaagtcaaaagccgatttctactatagtacagtatgtacagttcaagtacaattcacaattcacaattcaaatcaacaatctatcttgttaggatacataaataaaagtaaccaaagagacgcctaagcggagagcttggtctcaatgagcttggaaagggtgacggcgtcagcagcgaactttcggataccgtcggagagcttctcggtggccatctggtcctcgttaaagtctcgtcggaagatgggctcctcgtcgaggtaggccttcttctcaatgtccagagacttggccttgtcggcgaacagcttctgggggacggggtcggtggagttgagcagctcctcaagcagaccgggggagatggtcaggaagtcacagccagcaagctccttgatctcaccggtgtttcggaaagaagcacccatgacaatggtcttgtagtcgaacttcttgtagtagtcgaaaatgttcttgacggagatgacaccggggtcctcggcagcgtcgtaggtcttgccggtggcggccttgtgccagtcgaggattcggccaacaaagggagagatgagggtgaccttggcctcagcacaggcaacggcctggacgaaggagaagagaagagtcaggttacagtggataccgtgcttggactcgagctccttggcagcctggataccctcataggtggaggcgatcttgatgaggattcggtcagaagaaatgcccttggccttgtagaggtcaatgagctgcagagccttcttgatggtggcgtccttgtcgaaagagagtcgggcgtcgacctcggtggagactcgaccggggacaatcttgagaatctcggagccgaactcgatgagcagctggtccagagcaatgttgacctgctccttggggtcggaggacttggtcttggcgaaagaaacggcctcgtcaatgagcttggcgtactcgggcttcttggaagcggccaggatcagagaggggttggtggtggcgtcctggggcttgtacttggcgatggctgggttagattgtgttcagaggcaaactcgtacaactgcaatggaggcaccggtagcagcggacagagcaatccgaaaaagagcaaggcatgcgttactgggtaacacagacccaattgagtcaattgccacttgccctgccagcctatcaatgctgtgcgcgccacattaccatgtcgtgacatgaccaaccattgtaacatctgtcaattgcgtccccgtcaggatcaaatactcacactcgaattcaccagtgtcggtgacaacggtggtgccggcggccttaagctgttcaagagagttggaagacattgtgtgtttgtgtgtaatgttgatacagaaacagaaatcagaaggagggtccgaaggggggggctatatatgcgttataatcgacagcaaggttactctgtcgaaccgtatggaacgcccttagggttagggcatcttcccccaacaaggttctgcgtgctcaccaaatgcacgtgcatgtatatcttattgcgcaatgagatcatagtgctcagggagtgtgagggtgtgagaagagcgtggaaagggcggcaaaggaggcagaagggcccaatacgcagaaagaaaaagactcgatttttccggtatttttccgacgtcttctttgtcgctttctaaccaattggagtgtctcaaacgtcacaccttgcagtgtttttcattactacatctgccccaatctgctgctgactgggttgccagtcagaaatcttcatcatacgaagcaagcaagtgtaagtgttgatttaattaacatggatgcgacgcggttccgggatacagattacgagtaaaaaggagggtcagaagataaatgcctcgtttctccctcggcgcgctgcgcctgtgtctctctcaattgacgttgtattttacagcaccttagcgacctcggcatgactccagtgactcatgcagttgggacgttctggacccaatgttgaggtgtactactggtagtagtaaatgttttttttttctttcttttttttgttttaaagaaaaagaaaaaagtcgttccagagcacgtcaccaacgtcaaaagtggaaacggaggacataccaggagtatccaattctccatctgtcaatggctcctttcagaatctctctacctcgtctgcgagcctgccactgccaggtacccactctgccgtcagatgatgcatccgtcatccaccacctgaacagtcaaacacccagacctacgcaacatgctgacaaatggtccaaaaaggaggggaaaaacacaaagacacaaacggagccacctgcttacacatccatggaacgtgacctactagttgtgacttgagacaccgtccagaccgtgtctattggccacagtcccagccacatgagcatcttgccctgcttcgtctctccatcgccaagttagacttcgttgaggacagcacatccagaaacgtgtaggagggccaacttttgcaattgtctctcgaatgagacgaaagtagtaccatcggaatcgcctcgtcgtgctgttgctcgggatgtattcggttttctcctatcaccaatatccggctcactacactgccgttgacaaaaaaggaaaggatctacatcctgcacccggccaatcctgactaaactcgagcaccacgtttgagacgtactaccaacgttgtgacgtcaggggaccggagcgacgtgaatgggctcagtacaacgagacactacacttgaaaaacgtgttcgtgggtgtattgtgacgtcattgcgaaaggaataacggtggttttcaactcgcagcaagagggacatgatctatagtcccgtccgacgacacgcggcggtttcgaattccaccgattagactgattttatcgataacataatccttcgctcgctatttttaagcgagttgaatgtctctcagtaggttataaacacacgcattcatcgagaaatatgatgagagtggtcttgtgcgggaagaaacaagtcccggatgatgacaaggcggttagccgatcattctgacatccaacggtacctgctttggtctcgtctccaccccgataaaagaagctgaaaaaagaagtgggctcagttatctatgcaactctatccactcactgttcaacggcgtaaaagcacgcggcacgttaatatacgagtctcatagcagcttatttggtgacaattgggtctcggatgtctcactttgcagatatcacgtgatagatcaccatcccccctccaccatactcgcaatctcttaccatcaacatgcactccggtatcttccgagaaatccgagaaaccggcccgtgaagccaaccatgttagttgttggtttcacacacaacctgtgacacacatggcgtccaacagaaaccgttggaccgctcattttagtgcaaaacaccaatttcccgctactccgttgagtagcccgatttcgcatatttttcccgatataaggtttaaagccgcatttcgacaatggcttctaggagagcaaatattggtgttaggaacgaaagggagttgatagttgtattttctgggaatctgggtatctaaaaatatataatgtcacctcccaactcctggacaacacctggataacacgtcttaacgtgaatgtgtaccgagccaaaaataaacttccatttcacaagagtcatagattttttgatgtcctctgcaatagtgaatatcgagtccatcagaaagctatcaatcggaatagaatggttagacaagtagttatcttcatatagtgtctagatgtggctacatctacttgcgatgcttctatatccagcccaacatccaaataaagtttcgggacgtgctcggcaaatttcacatttacttctgaccatcttcaactcgactggagagccacgaaaatgtcgctgaaaatgccccagggccagctggccgcgccgcccacgctgtacaacttccccgatacctttgcttttctcaataagctgaagaagaacgacaccatccacaagtaccggacctccgtgggtgcgactatcgcttctctcatttccacgacatcgactttcccgctcgactccattaaaacccggcagcaaacatacaactaccgaggtacgttgcatgtcatttacgacacgtatcgccatgagggtatcaagggattctaccgaggtatctgggctcctctgatttccaccagtgtggtgcgaaccattggtgcttctgtatacgctgctacggtgcccttttcgcgggacttctggtcggtgcactttcaactgccgccggttttgcacgaccctgagcacgtcatggtcggtgaccacctggaccatttcctgctgcagtctttcaagatgacactgctgtacctggtacctggagccattgctggagccagtagcactttgattagtgccccgttcgagttcaccaagctcagctcacagattgagggactggttgcccgacagctgcaagccgcggccgaaaacaagggaggccacatcaaccagctggacgggttcaagccccattcggtcatggaaaccggaaaggagattctgcaacgtgccggagtgcgaggactctactctggatacaagtaccatcttctgcgagactccatttccacaggcttctacttcaccacctacgagattgccaagattgtggtggcccaaaagatgtttggaaagcagtcggaaaccatgcagaacgtcgccgttgcctttgccggagcctgcgccggtatcgtgtcttggactattatcttccccctcgatactctcaagtctgtctaccagaaaaatgttgtggctgctgccatggcccacaagtacggagtgaagttggacctgaacaaggacgcggtcaagatcaacagaattcgagacctgttccagcgacggctctacaagggtctcggaatctcgtgcatccgaaccgccattaacggagccattttcttctctgttctggagtacatccgaaagagactctaagagaaagagagacaacaccagttcatcacactggtaactgacgaacaagagacgttagtaggagtctcagcaatagctgagacatgtaattagaattattagagatgatatatatatttatactgaatgaattatgagagaattgacgttatggaggaggtggaaataggtgagagacagcatagcacatgtatatgcgatgtgaggaaatgaaagaacctgacagtaacagaccccggactactccaactatccaactacacacacagcccatactacaaatactgttaaactattgatgaacctgagacaactgctaccagccttggctgcaccaaaaccagtacgttgtaactggctgctctaaaaccatccgataagcctcgtcattccacttaatcaaaaaactttctggtgggggaaggtccgaaaatgtcggttctgatggcaggaagcttctcaataaacagaagcttgagtcgctcctcaagggtgttgtcgacggaaatcttcttggtaccgttgaacacaatgactcctccagaagactcggcggggagaacctcgtcgtcaagcttaacctcgaccttggagccagtctccttctcgtaggccttggaaacagcatcaaaagtgcccttggcgatatcctgatcggcctttcgggctcggacgtaaatgacaggctccaggagagtgtaggctccctcggtaataagaccctgcaggacagtggtgtacttagacttgtccttggaggcgtccttgagctgcttgcccgcagcctcgtagtactgatccagaacctcctgtcgggcgccaaggactcggagacgagccttgttgttgatggtagacttggtgatctgctgcgacagagactcctgcttagccttgacggcgtactgggtgtcgatgttggagctctcagctcgcacgatgttggccttttcaatctcgtactcctcgttggccttcagctcgatttccttggccttctcctcggcttctttttggatgaagtcgaccatcttccggagctctccggcaacctgggttagtatggtgcgggcagaaccaatccgtggcaatcattcacgggcggggggcttccacatatgacgactgacaggcacaacagaggccacaaacagaggccacaatcagaggccacaaacagaagacacaaacagaggccacaaacagaggccacaaacagaggctacaaacagaagacacaaatagatgtttccatagacaccatatactgcacaagtctgaaacaccccagacgtagtaggagaacacaacagtagttggtagacgaagatggcatatcactgaggtcacccgaacaactttggcatctttccaacatgtgtcgttgtcatgtgacaaaaatgtacacaagacatgcggcacatgaattgtcacatgtctagtacgccagtcaatcaaccaccaagtcaatcctttcaattgcgtcatttgaataccagaatctgtgtctcctccccacgtccgtgtttgtgtcactcgtgggcaacatgtccatccctgattgtgttggctgtcggtttgtcatgcccttctccttccactctactcacctgatcatcgttcaaagcatgcgacattgttgatatgtgtttggtgaatccgactgtgggcttgtggttgtgttagtatacagcgaacggagctgtgcggtgcaaagtgcgtgtgttggcttggtcgacgaacactggaggtacgttgcgttatgcgcccttgtcgacgacatgattccaaagttaatttgctgaataagcacgagaactgtaaccggggtgaccgaggaagagagcagagaatgttgatcgtggataaaaaatagtggacacgtgagaaaaacatccacgttataaatacctgttgaaatgcttggtcttatttttcttttatttttttagttcaattattgagaaaaatacaactgtcgcacggtatctgtacaggtaatacttgcaaaaccggaaacagggaaagtcataaaacagtacatctagacataatcaatcgttttatctggtaggtatttgtcgatatattggctaaaacaatgaatagcagggctttggtatttttctagtagctgctttgtcagttttttttattatttaatttttgatttgattttgatttgattttgatttgattttgatttgattttgatttgatttgattttgatttgattattgtttaatttcaaactaattttgatctaacttttatttgcaaatagtatcttaatccaattgaacatagccattaaaatgagtagaatcaacaggaaaaggacatcgtaatgtttcaaagactcgaacaatcaggtttgtcttcttcttgtttcaacaagcgcaggacagatgtctatgaactggtttggttcccgacaaaactgcgaatgaaacaaatcaagaaatgggcggttataacaaagtacatcaaaaagataaaaaatacatctcacaggctgaattatattacaccgaaactcgctttcatcaagtctacaaccgatgtactcgataaaacacgttataatctataaaagactcctagacaacgagagcgacaaaggggaccatgaaaagggcaatggagaacctggttgaagaagcagagttggcctgctcgggtgtatgttgaggagcagactcaacaggctgctggggaacctcaggggtgggcacaacagattcaataggtttgacaggctctgaaggaaactcaggaacctcaggtctagagggaacctcaggaatgttctccacagggacctcaggaacaggttcattaggggtctggggctccttgggctcctcgggatcctcggtagcaacaggaacctctggttgctcaggagtgggctgcacagggatcgctggaacctcaggggtaggcttgggctgctcaggagtgggttcgacaggctcggcagggatcacaggaacctcaggaatgggtttgggctcaggaacttcaggagtgggcttgggcccaggaacctcaggagtgggcttgggctcaggaacctcaggagtgggtttgggcccaggaacctcaggagtagtgcagtcttcacaaacggtagtggtagtcaccacagtcttacacacttcctcctcgcaaatagtaacggtctcggtcttgatcacgggaatggtgatgatagggtagacagggaagagaggtctggtcagtgtaggcttgccaggaacctcgggtacaggactggacttctcagggatctcggatgtaggagtagttatctgagggatctcaggtgtaggtgtagacttctgaggctgaggggtctcttcagggtcacaaggaacagtcagagtgatggtcttggaagagatggtggtgatgactgtggtggacgagggattgggaggcacgtgggtggtgagagtgatagggatagtggtgcattcttcctcacatacagtcacagttgtagtgtaagttgtagggccatgaggacagtaatctgtggtcactgtggtggtagaagggtttccatcaggatcagtggtggtcaaagtggtcacacacacagtggaactaggtccaggagttgtgctgagcgtggaaggctccgaaatgggatcggaagtctgggggagctcagtctgcggcacagaggtcatgggagtcacaggcttggaagtgcaaatgtcagtggtgatggtgtaagtggaaggctctcctgagggaggtgtgctcacaattgtagtgacagactcgcaggggtcagtagaagtgactgtatcagtggtgatgggctcagaggtcgaaggagtctctgtcgtgaaagtctctgaagtgattgggatcgaagtctcagggacagacgaagaacaagtatttgtggtgacagtagtggtgatgggaggtccaacgggaggagtggaggtaataaccgaggtggtcgcacaagggtctgttgtctgaggggtagaagagggtggagtggtttgtttctcaggagttgtggttgtctcggtggttgagggctcagttgtcagctgctcagtggtgggctcgggagtagaagagggctcagtagaggaaggctctgttgtctcaggagaagagggctcagtggaggatggctctgtagtctcaggagtggaagagggctcagtagaggaaggctctgtcgtctcaggagaagaagagggatcagtagttggtttctcagtggtagacttaggggtggtggactcatttgtggtggtgacatcgagggtggtggaaggctctgttgtctcaggaatgggagaggactcagtagaggaaggctctgtagtcacaggagaagaagagagatcagtagttggtttctcagtggtggactcaggtttggtggtgacatcgtcagtggtggtgacatcgtcggtggttgaaggagctgtagttgactcaggagtggaagagggctcagtagaggaaggctcagtagaggaaggctctgtagtcacaggagtagaagaggactcagttgaggaaggctctgtagtctcaggagtggaagaaggctcaatggtggactcaggggtgctggtgggctcctcagaggtagagggaatcgtggacgactcaggagttgttgttggatcttcagtggtcgaaggctctgtagaagaaggagtgatctgctcctcgggggtagtgatgggttcagtagaagagggaatcgctatgttagttatgagaagaggacggtttaggtgatgcatctctttgaattgtagtcccatttagcagtcaaattgaagtaaaaggaaccacggcgttcaatgagtttgtaacactgctcgacacgtgtttgtgtcggaattcgaaatacttacactcggttacagaagcagatcctccgccctcgggtgggcaggcgtcacaaatgtaggcggcagctccggcagcagtaccggttctgtccccgggggttgtccatcgagtatcttcgttggggttagcatggtaccacagtgtccattcaacttccagatggtaaacctcagcaattttctcgatatgagaaacaaaggacatgtctacgttgtactcgccctgtggatggtttttggggaggttgaaaagtcgaccagtgaatgaagtaggatccgccttggtaacagaggtgtagtcactgttttcataggggttgatgggggtcacaccagaaggatttccaaactcatcaacgtcgtgaagcagctccagcaccatgttatccttgatatccttgacgctcttgaaggcggagtttccatcaggaattgtaactgtgaactgaattcggtcccaaggggtctggggaaatctgacagtccatgcaaacatgtcgtcctttcgctgtccaaatacatgggcctcggaaacctctatgctgggatcgatggtaatagtatcagagagagtctgcgagccagactcgacagtaacaatgatggtctcagccgtctcgccaagcttggacttgtcgaacggagcctcgaaagaaatgtctccagaaaggtcagtctttccctgaactgagtcagtgtaggtggcagtaaaagtgtttccagaattcttgatttgcatgatgtcgtttccgttctggtccttgactgtgaagtcatgggacggaacactagcccggttgtcaacagtaaaagtgaagtagtcgccagactggatatcgtcagcagtaggattgagctcaaagtccaagtcccagatccactgggcagagaacttgccctccttggagttatcagccagagtgtggacatcaagagaggtcagaggcgatgcgacctccttggcaaccactaaaagtgcctgcagtgccaacaggtagaatggtttcatgtcgttggagttgtaaaacgaaagtgctgagttgtaccggaccacatcaccacagaaacagttgtatttatatattggggcccccctcagttggaaatccacagcaatgaggttccatgccacaaaccacgcatgtataatttattttgaacaagcgtatgaggcattggacaacggatgatcttgtatttgggagccgcagtcagtgggtgtattgagaagttagtcagctggtaaatgtcttgaaagtgcacagaaaaagtagttgaagacaacaggttgcctgctcataaatatccatcgatatccttctagatacccgctacactcgtatgggcaaagttatacagtatccgatgagtatcgtgttatagagttgggcaattgactggttggaaaagccaagatgcagagtcaattttagacacattgatttgctcttgacgagagaacagtacatcatagtcgcacttgtaatagtctcacaacactgaatccgacatcattagtgaaatagaagcatcagttcaacttgttgacaattgatttctctctaaattgatgagcaattgtacaacttgtctccataacctgcctaaacctggtggacatgctccctcatatttgagttcatatatgcaggatgcaaaattacttatttgagacacaatagagccacgatccattgttatcccgagacgaagagactctcggacatattggggccaaattacgcgaaatttgaacccgtgatatgccccccattttgggtcttttctgcttcgttttccgaattctcaaatcctccgttatgctcgacacggttcctacgtggttttgttcagctacaggaacataccctttggggagtcctatagagatcggatatggcgtgtcaaaaacagaacctcatcatattacaagctctcttctcagataaagaacccttcggacaaatgagacaccgtgtttcattctggcatcaagccgtcttgtggttgaaacaagagcttgcagtgtcaccagtcaccaatattttgagatgacatgttcttaataattcccttcgttgtttgtattgttattcggcccttgtccctgttaaccgttaaccagtcagcttgtgcactgcaaccgcgctgcaacttcctgtacccacatgcactccgaaatatttccgtatcgagaacccatccacattctgttcatttacttctcagtgcgcctccttgtcatattggttctattgttagatcgtggcatggagcggcggggtagagtgaaatgtgaccaaactggatgatagtgaagcaatgaaacggacaagatctggctattagatcatcagcagaagtaaacgtgcgaggctgctagtatttgaagtatctttcggaaatccatgaaattgtaaaaggtcaaaattgttcaattgcaatacaatatgctgcacatgacgatttccattccagctaggaacatgctgtagtgtacactgtacttggatgatgcgagatttgttcagtataatgtacataagtgcagtacttactttactgtacgcaatgcgtgtgcacgtagctgtaaatagcaacagagagacactctctagagaggtactggtacaattgaatatcatcatggctcttgtgatgtacgcccccactattggtgttttaacggtactgtgctggactcatcagggatgccattgctctgttcatatggagagcccagtggaaactaaacaggagatgtaaaaaaatgagtccacacgcccgaagaaaagaatgccgaggcactgaatgccgaagaaaaagaaaacaaaattaaagaacagagttctcaagaatgaagaaaaaaagttcccagaaccggtgatcatccaattacttgaaaagaagcgtttaacctagatcatgtatggaagatataggctacttgtagaggtgtgcgaccactgggcagtgcgggtccaagcgactgacaatgtacactgtctcaaaaatggggaggtggaatgtgttacaaaataataagcaataaaaagacttcttcaaaaggtcgagacaatcagagtaatcaatggaaggtctcccaggagaagtattggagtcaattttctattatccaagactgcatcacctcctgttgactctgggctggggcgcgaacagccacagagagtccaccactttggaggaagtaaaccatcgaatgggttagttgcgataaaaaaagactgttgagatttatgggactgagtacgggtaattgtactcaatgagccatgggcgaccatattaacgactctagaacacacacacagaatcaaagcaagaaatataacccatgtgtgcaaaacacataataatttcaacaacggaaattgtagcatctgtcctaaactcgtcagtcatacaagcaaaccaatactgaaattcaagggccccttttgagacattattctatgagaatatatatgatgtaactatatcttattgtcctgtttttctcaacttcagtgtctgagctatgctgacataatttctcattataagtacatggtacgtccaaaagtacatacagtacttcatcctcgtatgttaaaataataaactgtcatactgacgtttcattcatctcagagatgatcattgttgcagcgaaagaacttgaagtctagacttggcagagtcaagctgcctcgaacgcttcacgacagagactaatgaaatgagttgtactaggacgaatgttgagcatattccatgacaaataatgaatttatttcacaacaaagtctttgaaatttggcctttcccctcacccttactaagtacaactcggtccagtgtagaacatacagtacatattgtcctttttcctactcgtactcgtactactccctccttggtatatgcaacatagcaacatgtccactcacttaaccgacgacgagtttgatccagtcggggcttaattagaatcattctttggataattcctctatttccccaattttctcttttatttatttttattgaagttctgtcacattcaaacagtttgaaagatggagttgctaaggcagatgagaacaatacgggtcattagatggcaagaaaacaccgcaatacctgcagaaatcttgagaacttcttggtcataaaaataatttatcaatcgattctatacactcaatgaaattgatatttgttttctcatattggttacatttgttctcgaatgctctagatatgcaaaatcaaggttaaggttctattttccacccgaatacgacaaaatgaacatccaccaaaatctggtacggacatgaacggttgattgttattatgatatttgcattggttaaatattgtgaattatgcaatagatatggttattgatttctccgtgtatatcacttccctttgctgtacgcccgttcttcgagaatgttcactcgcttttgctcatgcaggggtcgacacgaatttcgccgctaatgcaactctgacattacgaatggagactcaataaggctacctcaacagtataaaaggccccttgatcgccctgtttttccagtatcagaagtcgatcagtctctcagcttttgcagaggatttgatcacttcgagagatgcagacaccgctgagcgaaagctatgaatcagtactcgactggcgcgcgagcggatattcacttcacccctaccatgacacaacttgagttctcttaactgacgagttggagagtcagcacacctctcttcatgcatctacgggatggagctaggacgagcaaagattcgctatctactcaggagctccttctctcagatggttcgcaaccacgggtgaaactcccagcatgaacaacattttggggtctgctctactggttctgtcgcaagacagtattccagaagttgctgaacggatgctgcaaagcctctgctacgacgcaactggtgagactgattaaaaacgcatgagcgagtaactaaaacgtgaagctgagcacaaactacgaagctaccgagtgaaaggaaacccctcagtacatgcactaagaggacgcagggtgatgacgagttggagacttagcaagcccctcatgaatcctgtctccgtggatatgaagcggtgacggacacggaaacgtccatgagctctccgaaagtatgggtagctcccttgggtgcaactccctgtatggataatacctcctgaatgctttggagggatggactgtcgtttgaacagtcatatgtctcctccatctgctgttgacttggtatcagcacaccaggaatcacggtaaagagaaccgctgacacacgatccgaacctgatccagctttttccgcctgagcataagcgtctgcaaagaccgccaccgagcaaagtgtttgtgcccaacctgccagaccgccagagcaaagagccagtccgagccgcaatgagccagaactggagccgccgaccgacaaatgccaacaacaaaacactaagagaatgctgaaaagccgcctggagttgcacgatggtgaaattccaccagcccccagagaaggagacgttgtagcgactgagacacgttaagttatgccagcacaagagtgacactgtgaaacgatgacggcagcgcgaaggtggaactgtgaactgtgagagcagaatgccagcaccttgagagcatgggccagagccaatcagtaagagccagagccatgacgataagccagtgagtgtcaatgagctaataagagctaggtgttatgccaatgagagcctgagctgaatcgagccagagccaataagagcagagagatccaaagccaacgagccagatctaaagagtcagagctccacagaggagccatactaaaggcagtcggaagttgatcttcttgatccaagaaaggatgtaggcagtcgaacctcgacacgaggatgtagacgagaccgaaccttttagtctatagaaaagaggatgtaagcagtgagctgaacctctgggattaatatattatggcccatgaaagcccacccaaatcatcgcctgttatagtgtttctgtaaaagtagttgtgctgaattgtagataagtgtcatggaatgcaatgcaagtagcttcacttcttaggtatacgaaagagtatataaacttttcaatatcaacaatgaaaatttcccgatccggtaatatattactgatcttaagggaaaaaactaggaaaattcaacttttatagtccataattatcttatattgctatataattccctaatatatatactgtacgactattttcaaagtaccaaacagtccccactgctggtactttgaaaatagtccaagtttatgactagtggctaccgacaccaacagcccccactgttgatgtttcgacgctagtcatgggtttggtctcatcagggcagccagtcccccgttgtgcttgacgcgcaaataaaaaaaagtagtggaaaatccactgagccctaatccgacaccccaccacacaactgacattgtgttttgtacactgaaaaagagccgtcaccgaaaaagagccgtcaccgcaaataaagccaaaaccgcaaatagagccaacacccgaaagaaaaaaagagcactggggggcacccgagacctacttgcatcactggaaagaagcgtaagaccttgaccacgtgaggttggggggcgtggtcgaagggtaacaaaagtggcatctctgcgagattccggtttctggaggtctggcagaatccaccgcctcgagcaatcttctgtaaaggaaattgagacactagagggatggggattccccttcccaatcgagtctcacgacgtttcttcctattcaaaactgccagaagaagctgagacgaccttgatccgtggtagactccaaggaactgaaacgaggctgctctatagggccttgggaggaactttccaccaccccaacgctgcatcacctcctttccggccctggctctgtaacctccttacagagtgggtcctccaccgcactatgtgccaaatggaggggaaccaaagctacctcccgctgtgttagtatcgctctagagttttcaaaggcttacgtggaattagcacatgtctctttgacagctcacttgaagtgacacagacacaaagagctagagatcgtgaaaactcacccaaaagccaacctgaaatgaatgaagaggattgagtcgatgtccgttgaattagtcgtagaagatgtgtcataataatgtcgtagaagtgtcgtgaatgaggtagtagttgatgtcgtagagtgaggagaaatgaggaagaaaaatagaaggccacaaacatcttcagaataaggtaaggtggagatgttacacagacgtggtataatgttgtggctcttcaccttaattgtatgttttgttagtcgttttaccgtaataggaaaaaatataaaatatacacgatgtatattcccaggatataatcccttattctatatatatttttaattgtattgaatagatgtcacagtcacaactatcaatatattaaggttgagataatgcaatggagtgcatatagtcgaaactttgttaattgggcgatgagctattgatgattgaattagattcctcatgattggacaataatacttgctgtatctataatggcattatcgagagcttagtcaaataaatcatcaaattgcagtaatttttgagggattgagggaattgttctctttaaatacgcgacctggtctgcaggagcatgtggtcaaaattttagatgcagacttatcattgtgaaaactaaaaatcaaggaaacaatgagattcttgtacttgtaattctaccaaagctcatagtatctagtacttgtactagttttctaccacaggtacacaaaaaacatctgcaggtcagatcagttcttacacggatatcaatcaactttcttaggtacagtacagtactgtatttgaaatccacctcgttatgaccaataagtgatcccggcccccagaaaggtcgactgagatggtacatgacgagatcgaagttcgacgccatccagagggctttaatctgctgcaggagctcccagatattggccatagcagagctttcttcctggcactgatcgatgtgttaaaattggcaccagctacagatatacgagttgtcataatatgactatcggtggtttcgaggtctctctgtcttggaaaaaactattcaggctggttatagggtctgggagtaaatactgttgtatcttgttccccagtatcggacaggagaaaaaggtgtagggtggcgttaggatccggtagtatctgagtgtacccattatttgatgccaacaccagctctctttgccgttgttccataaatgacccctacctatttccatcccgcaggtatgactcaagtcaataagcctttcgaagagtcaatacgtcttagatgtggatcgtagatgatttacattaggtctaaaacacagctgcttcgcattgtgaccattacaacatctgatacttggaaaacaaaatacagtagcatttacacaatacaaagcaacgatttgggttattaaacatacagctcttgtgcttcaagacaattaatacattaattatatatcccacccacacaaccccaacatccccttagaatgccttatccagtattccctccgccgcctctggaagatgagattgagaagaccacaacccgaagactcgagcactttctccctcgcacccagaggtgattgagaacgagggttccagtgcttttcccctcacacacggatgtgattgagaaggacacgcaacccgaaggttcaagtgctttctcccccacacacggatgtgattagaaggcgaaacatcccgaaggtttcaggatttctccgtcacacactctaagcagccacaatccacggccgacggcctcccaccacccctcatcttccactgctcctcaccttccaactcccctcgtcttccagccctcgtcaccttccaccgcccctcatctgccatccaccacccccttccaactcccctcatctaccatccaccaaccaccacccctcactctccccacacctcctgtctttcaaacaagcccccaaatccactccgaccttccaccaccaagagcaccaacgtctatgctccaacatcaccagtgccaaaattatcatcgatagcaagtaaaaaagtaaatctcacgaaccggttccgccgagaacgtgagtgacgctagtctggtttcgtctctgtgcaatcagactcccctcttgggacgcgaagggtgattgcaagtaggtttgaaactgactgggttgtagcgtcgtgtctaaagacgaaaatcgtcagtagacacgggttttccggggcactccctatgagactctgtccctgagttcatagcatgcttggaacctgggcatggttaacgcacaccctccctgtaaacaaagtaaattcctccctgggattgagatgcccccctggagactatggcctgtcgcctatccgacaccctcggaagacgtaatcgtttggcccacagctcttcgggaagcacccgtctatgactagcgctacctatggtagtaactagatcgtaggacgcccatctatgttagtaatttgaaaaatgtggtggagaagacatggcaactgtgggggactcctcttgtagctgagacacttggttggacggcgatcaaggtgctggaaacatagatacctgtagtatgttgtttgcctgtgtcgtttttgtgtcgtttttgtgtcgtttttgtgtcgcgtttgtgtcacttagtgtcgtgtttgtgtcacatggcttggttgtgggtatcagtcgtcgaaaagcgtggtcggtgatcgagacagtgtctgtagttgcagtgtcatcgacctatgtgatgaaatcaaggtatcccatgacgttgtgtgatgtcgtgtgtcgagctgtttgtgtcacaaacacccgatttgcgccacaacggtgccaaaaagtccccagtggtgccagtcgaacggaagaaagcataaatactcactcaagccgcctctttcttagccggcgacaaaaagaagccgtctttttcagtgttcgagacgaaacacgtacttggcggattcttggcgatgatggttaacatgaatagtggattctggagaatctagaaactgggggtatatttatattacacaaacagacaattaagctataaccaatatgtgaccttaaattatggcttgatttttacgtgcggggttcgtatcaagaaggattatataaaaccgcgaattcgactccattcaactccaattttgacgatgttcaatttttgggttcgaagtagtgcatactaaagttttcatctcattagtccctgcattatcaacactaacaccagaaatacatctctggtgttgttttatgcccgatgaaataagcttcgtgaaaatggcctgattttctggtcaaagtggtctgattatttggaaagtttatggcactgcaagtttatggcaccacaagtttatggcactccatttaaggttacccaacaatttgttcatagcttaaatgctctcaacaaactccttggaaaagattatatattggtagtatatctactaatactcaactaactctctatataattgtttcaacctgtgtaacattcccccagcttatgtctcatgtcatttgtgaagaattatttgggagttttaacgttcttgttcaaatacttaacattactcaacagtttaacgacattttgtgtagtaaccttaatatgaggttcccctcacttgaagaatagttatcctcaggtgagtctttgaagtcgcatgaccatccgattacctgaaatacttgcttactaatagaaccttcacagtgagaggcttgtgttggtggccccctaaccctagttgcccactcgggcatgaatcacactgggagatcattgtctggagacaagacaaatttactaacggcagacatgaaaaagtcgattacccgtttatttcgaagaataaaatgttacgaaagaagctagaagatttttacttcaaatgagttgctgaggggacatttattctcaagagatgctcaatctgttaagggccctgccaacatcaggtcttctcgctcactcccagatcacctgtacattactccatttcaacacttcttttaccatatatgatggaagacgagatgaggaagaagctggaagacgagacgaggaagaagctggaagacgagatgaggaacaagctggaaagtctcactcttgactgggatggtgctgatattggcacatcccaaagctaccaatctcccttatattttttgacgatcttattgaagttacggggagacgtctggagaaccaacggctgggaaacgagaagaaccgccagacactacatcactgatgctccgcagtagaaaaggatttgacaaagtatacgccaagtttgacctcacgaatgctaagttcaacgaacagtcaccagccatcgctaattgcatagttgctcatggttcgcagaacaatcggagatctgttatcatctatttcacttgcctccagatggctttttcttaagttacatgaccattgacggtaacaactggaatgccctctgtcgtcatgctctcaaccccgactcagcgctcccctgtggccacgccctaagacgtgatagtgcacgtccagtagtccaacccagacatcctgaatgatctggacactagtcaagagaccctggatacctggtccacctttgcgccttcacctttgcttcgtgacatgtacatgtattaaagtctgagattcaaactagacgttctcaagtcccttccattgcgaatctcggctacgaatatgtctgctcgtgctcctgccacaggctttttcatctcatacaaaggctattcctcctgctaaaccagctgctctttcgtccttcgtctgacaaacctgtggcagacaagacggtctggatacatcgagacgtcctcggtgacgctcctcctggctacaagatgaagttcaataggttaagcctgataatatgaagaaaggttcgttgccctcccctgcggtctgtaaagctggtgatcatctgtttgacgactgttgagacattgacgtcgctggtcattttgatcaactccatattcgagtacagtacttgtacgagtacaatgcaccgggggtacagaacatatgcggtaatgcaaatccaactgctcgaatatggatctgaagagaaaaaggtgcccggtgaaaaaaattcgttgtctcatatttcaacaaagggatatttagagttcaatttgcactcgatacgaagaactttattcaacaagcgagtcaaccttcaatagctcgaaagcctcacattgaaaaaaatgctgttttgtatttaccacttcgattatataatatttaatggtttgtataatatatattacaccaaatataatgtaaaaatctcaatttccaagcccatgaagagacgttcctcaaatcttctacatgcagaggattccgtcacatcaaaagatgctgacactgtcgagtgaaagcaaggacgcagtacttgtcttgcgcgagcagacattctcagttcactcctaccgccagaaagtattccaaaagttgttgagtaagagtttcaaggctggcagctgggcaactggcagccggacccgcggcagacactgcgtcgctccgtccacatcatcaaccgccccagaactggtacggacaaggggaatctgactgtctaattaaaacatagctttgcgatggttgtaaaacaatgttgacgcaaagtgatttctgcccagtgctctgaatgtcaaagtgaagaaattcaaccaagcgcgcgggtaaacggcgggagtaactatgctctcttaaggtagccaaatgcctcgtcatctaattagtgacgcgcatgaatggattaacgagattcccactgtccctatctactatgtagcgaaaccacagccaagggaacgggcttggcagaatcagcgggaaagaagctccctctatgatgcaactgattaaactgtgtgtggtggacgcatgactagggcgcgaagccgagcgtaagctacgaagctcccgagtgagaggaaacccctcattacatgcactaggagaatgtagggtgatgaagagttggagacgtattaagcctctcatgaatcctgtctcagtggatatgaagcagtgatagaaacgaaaccttgttgatgagttctccgacagtatgggtactgtagctcgatatgatggaactccctgcatgaataacttctgattcctttggggagggaatgttgtctggacgctcatacgatcatcccaatgccagtatgtgctacagagccaatgagggccatagagtggttggagatccaacgatcagattcgcattcagaaagggtgtgggctgtcgaacctttagatgcggacattgacttagccgaaccttttagtttacaaaaaagggaatataggccatgagatgaacccctggggacaccaatcacggacaatcgagtcctatttgatctgttacttgtagtggaggagttgcaattgtcgtaagagctataggagactgattatacatactgtactactcctaaacatagtaaccaagcattccatgaatgtagtagcttcaatcaggccagttacttaccaactcgtgagctttcaacggttttgttcagcattggtattgcgacaaggttacttgagatggtcgtggggttatagcattatgacagagaagctcaagacgagtaaaatcagttgtgttgggtcagtttcacgactgtccaagatacgagtgtatatactgtagagtgaagaccgttgtattgtagtagggagaagatcaaaaggaaggtcattagggaagcaaaaaggtgaattgcagcacccaggattctcgtatggtctcccactacaatactaactgggctctctggtgcttgactatggctgatcggacgggaagccgtattttcaccaggatatggccgcaactggaaaaagaagttgtttaaagcatacgccaggctgagaaagtcacgtgtgggacaatagtagctctaaggctccaaattatgttgctgtaaactacttcttctgccccctgctaaagtccgctcgtcatactcacgatagagggatgtcgtcacagggagaagttgggattcaatggtcaatgatattgtagcaggacaattaatgttccaaatgacttgaaacctgctgggaagaagttcacccttatccaatcactttctttttcgtcgcacattagttcttttcaacaatagtatcggtgagatacagcagctcaaatgcaagacacgtacgaaataatggcccatgacttgcaaaatgtctttgaaatggtaattggggttgtacgacaaggtccttcgagtgtttttgacaaaaatatgacctcatttattgctcttccgatgctccgcaggttactcacgtttatgagcggtactgtacctccaggctaggaggaaattgaagtctgggaaatatatccaatctacaagtatacattgctgtagtgtaatgcacaatatgtactaaatagtagaggtatctcatttcgtacagtaccatatctgcctggttcgcatctctgacagcaaccgaattttgttcagaaatcaggaagtgcgtgtttaaagaggtgaatatatacaatcaaaccagaggctgtatcttcacatatcgaagctgtatcatcacatatcgaagctgtatataagttatatcagtgagtcgtcaaaggtattttccatattctgctcatgttatgttgtccatttcgactcagacaacaccgaaatgagcaaagcgtcgcagacgtgattgaaatgaacgactaaaaagtatttcagacatctggaacaccagttgctctactcagagtgcaatttaattgcaattcataattgtgagttgttgtaaaacagttggacagagttgtttgaaatttcagaaagagagaggatcgctaggtggcttcaatagtagcgagtgaaacggaaaacaggtgtaaggaagattcatcgtctgatgtcaattggagtaattagtactagagtttcaacttcctaattctgtcaacttctgaattgtgcacaacttccgccgagagcacaaccagaccaactaaactccagatggaggaaggtgttcataagggaattccttggatcaagaaaatgtataggttcttcttggaagatgttagcgaatttattggaagctctctggcacatactggaatcctctcagtatcaaatggcagaggaaagccataatacacattgcttcagatacaatgcgtgcgaaagccctcaagattgctattaccgatgcaagactctttttgaatcggatttggttattgaatagtcatgatgagcgatacagctactggtacgtacataaacactgatggacgaactatctaaaccgttctggaggtgtcactctagtgggtattggactccaaatgtgtagtacatgttaatcaccatgtcaaaacctgagctttcgggctttccagaatttcccaggcgtaaaggggggaaagagaagacaggataaaagtcacagttatactgtttaggccagttccagtgatactgccccatctgcaagattgttgccagattttcccacgtctcagtgtatactgtgtagtacagcagcggatatactactgtacgcgttttcctgcctgcagtacatactgtacttatagttgtacttgtacctactctcacccgtgtcgcagagttcataagatgaccctttctgtgtggagacatggagatactaccagagtccttgccggatggttctacttgtacaggttgactcactctcagtactgtatataccatagcacccataatgtccctcaaacagtgggtgaagttcctccctcacatggtccctacgtccacagccagcggtatggtgtagacacaacttttcaaggactacgggttttgaaaccccacaactgaatccgaacagaccagacttgctccccctgagtcgctccctgtcctatgccatgggccaatcacagctgacagcactccatgactaagctctgactagttgcgatatctcggatctgcgaacaaaggtgtcattcttgtgcacaccacaccgcatccggctaatactccggagacgcagacggtcgctggccgattggcaaacttaactcgaacttgttttggcagtgttggctgctgcacgggcgagatctggcagaaaacaagtggttccaatgatctgtacgtgcgtgtctggcaagttgcaagagacgagtagatcagtgaccccatctagagggattatgacctgcagtgattgctcttaaccaactattgccggcctgacacccaacaactgtacatttgggggttgcatctggatgcatctgggttgctttctgccgtttgctttttccgtccctgcaagatatacataaatccaagggcaaataaagcagagacaaccaaaagattgacggcgggtagaacgattcgaattctgagtttccggaccctgaaacaagctgcttgtatacaagtgtccgacacttgtgttagcattggtatcaacaacctccaacaagttgccaaacctgtgacgaatgcgtaatcgggcgcactacaagtagcgtgttgggtagtccgcatccccccagcccctattccacactagtgactctagtgccgtattatgtgaccactgtacacgagaatacagcacgtgccggcaccatcctgacgtccaaaatcgtagctataaccgaaggctgcatgatggagaatttaaggtttactcaccctgcacctctttttggacatcgccatccggtcttctttctcatccactactattcacctaaatcaccacaagcacattatgactaagtccttcgttcccctggagtgtaaccccgaggtctttggcggcctgctcgacgcctggggcgtgtccaagggctcgtttcacgacgttttctccattgacgagcccgagcttctggccttcattccccgaccagtggctgctctgatcctggtcttccccatctcgaaagagtatgaggcataccgagaacaggctgacgcagcagctcctgactacgatcccaccacggcgcgatccgagggcgccaattggtggccccaaaccattactaatgcctgcggaaccatggcacttttgcattcggtggcaaacggccttccgcccagtgctgtgcccgaaaacagtctgattggccagattgtcgcccaatcggacaccctcagcacaaacgaagcccgtgccaaattgctagaggattccgagccgtttgaggccgcacacgtttctgtgtgtgatgaaggagagaccgacgctcctgctgctgacgaccctatcgacttccactatgtggcactggtcaagtcgcagaagaacggccacctgtacgagctggacggacgacgaaagggacccattgacctgggccagttgcaggagggagaagatgccctgtcgcagctgtccctgaataaggtgagagagttcatggagagagagaaggagagtggaggatacttttccatcattgctctttctgaggattagagaaaggtacggtactcgtagaagagagagcgggcgagcctcaaggtaagtttcaactggcagaaatgctacaaagatctaaatagataattcgtgttacaatatctacaacgcacaagaaggtagtattgtatcgtagcgtatatattgtacagtaatacattccaaaatcgtgtttcattcattcgtacaagaccttgctacagctccctacaatatgtataagttaacgatatattacagtaaacacttgttactggcttctaggcgatgcaaataactatgcatccaattcaacctcttccttactaatttacatcatccctgaacgctctggtgccccttatgtatgacagacagcgttttcgacaaaaaaaagtgacagtatgaggatcctgacttcatccagtcactccgacccgaacgttagacctctagtttgcgtactgcgttgtctgcgttgtctgcgttgtctgctgtgtctgctgtgtctgctgtgtctgctgtgtctgctgtgtctgttgtgtttgctgggtctgctgcgtggtttgaccactctcatgaagacaccagttgatcaggctcaatgccggatctctatctttctcatcaaacagccaaagaccatacatctggccatcacttgccgaaaccatgataaaggagtcttccaaactgctgttcatctctgggatgtcgttggtgtccttctgaacgcctgcgtttgtgtaataagagacgttttgaggaattaggccgagggagaagttctcgggactagttcggttgagaatgatgagggcataagggtagggatccgtctcgtcctcaggagtcactcgccgactgtagatgaataatgtgcccagcacaggcatcttctcccagctgttggaggtcatggagaacttgtatactgagcagatggcggagttgaagaacacctggccagttttctgatcaatgttggtcagcgcgatgtggttgagcgtttgtcgcgaatactcttcaagctgttgttgtttcttcttcagctgggcgttgccctctgattgcttcttcttccgggccatttttatacgtgaagacaaggtggttgtgttcgaacgcgtgtttttggtgacgtggcaagttcaattttcgtccagctgcgtctatactggtggggaaggtgtatcgcgtggtgatgctcgtcgtgtgtgttagacgatgacgatgatgagtaatggtgtagtaccgaaacttaatatggcttactaagcagggttgtagaagacaggtaactaatagtacagtatgtgcagtatcagtatgtgcagtgtcagtatgtgcaggtttttcaggagcggtttctcatagagtagttgcacgtgatctatgtcttttcttttgttcgctcacaacacatttatacttacataatgcatttgcactcgatcctagctcacagatcataacaaataactctttaaaagacaacattataggtaaagtttagttgatctactttgacatgaaagcgtgaatgaatcactttttttgggggggagggtcttctcttggatggaaaaacttgggaatcaatgaacaagaagacaagggccaaggcgaattaaatgcaacaaaaacagattatggaaacataatatatccatcctcatctgaaggtggtgtacccttcaacttgtttctcacaaactccagactgaacacgaagcacttcaacactccgtccacgactccaggcatgtatatggagccttcattgtcttgtacaggcatcttcaatacgaccatggttttcaagtcaatgataaactgcatcacatgcccgtcaccaacaccacacaggtatcgtgggtgtcggtcgtcctgcttgatatatctgcagtcagggaaacacgataagaccatttgcttgcataatctttctgtgcccaaataagtcaccctcatcagcttgtcatttgagaaaaagtagaacttgccctcgtagactgcaacgactccacccttgagcggctccggctcgggatgttcaccaagatgaagttccatgtcaccattgatgtaaagaagcatattatccggctcactgagatcgttgaacaagtgtgtgcctgctagaaaagacgttgaggcctctgaatgtggatgccgtataactgtgaaatccggttcaaagcttttgacgttaggaccactaagtaatttgaagccgtagattgcagtatcgtcagcgtcattgtcccgggcctcaatcacaagcgcctctggactcataaagtcgtcgcagtaggtgtacttggccttgtcaatttcgaacgaaatttgaccgagggagtactggtggtctatgacaaccatgccacccttgtgccacggaagccgggagtcagaaagatagacgagacaattgccgcactgaaggcctcgatcgttgaaccaacacttgaaagatgctcgatagccagccagaccaaactccctatcgacaaagaatcgttgtgcgtactccatctggcctccgaggatgcattcgaagctatctggtaagggagagttggtaagttccacgggaacatctccttcggtcaacccgcgtgactcgcagaagtagttacacaccccttctggcgtgatgttggatctataccatggacaaaagtgtttgaacgcatcaacggtacgagacgcaaacagattgtagaggtttcggttacataagctgatgcttactaactctcggatatcaagatactggccaatatttaaccagatttcatttggtatcgcggtagcggtggtcatgttgggtgagaaaagtagggttcaattaacacgttgaaatatttatcggtccctactaaattttatgtcgagattttgaacttctctctcaattgagtgtcacatcaaacgacagggaatatctactgcgaccccgacaacgtcaagaaggtgctcaatgaggttggagcagtagcagctgtaatacccgtgttgcgccgcggcggctcacggggacactgccaatgttgctcaggaaacaagagtcctgtgttataaaagtgggtcgcaagtcgatctacttgtaaggagtacagtacttgtagatgatacgcgccagaacgagctcaatggcagggccttcgactcgggtaaaagcccttcgacaactatggcggttgttttcgcaaccggttgaagtattcatgcgggaacgagctacattggctcttagcggagttgctctattgtcggggataacaccctccatcgagtgcaaacaccgggaacttccactattgaagggatctcatcgagggagttccggctgccaaaccactctccgagtcagttttcaagctagggctccggcatggacaagtttctgtctttttgggctctgcaaccccgtctacagtcctgtaaaccgccatccaagcccattgttcaacttcttccagactgaaggaaactacagtatagctaatgatctggaaggaatgttggagctacttgaactcgacatggtgtggcgaacagacgcgggtggaaacggccatcttatgaacgagtctcgctcgctcttgacagggaccaagaagaactctctcagggagatgttcggaaaggccccaatacaatactcgctttaatatacctggcttgcacgctgttgttctgacagtgaatgcgacagtgtctacatccaggaccgagagatacacaatacatctcctatcaatgtttcccatttttccaacagcaattattacaagtacagtaccagtcgaaaaaacggtgcatcatcatctacaagagtgcaagcagctactacttgtgctgtacttcaaatgtacactgccattcgagatggagtagctactgcttgtatggtacagtagatggctcttctctgggttggagtgggcgtccatatctccgacgcaatgaacaacgacagtaagacattcaccaagccttccacctcaccgtctagaggaatttccgccgtgttaataggcaatttccgccttgttaataggcaatctccgccttgttaatagtctcgatattatcggccggaatcgaacacaccaaacacacgtacagctacaccagactgtcaaactctactcgtgtttgtttacgaatgtctaaatggggttaaggttgggttggtgcatcatcatcatcacaagtgcaacaagtattttgacatagctacgaacacaagacatgaaacgacgaacttcgtatcttcagaacgagctggagcggctatcgaacgagctccagcttgttttttcggacgtggggttctcgcatgctgaaaaggaggaaaaagaacgactacatttccaaaaactggtggaagcgctacagatacgacttttggaggaaaagagctacagagacgagctcaagcaaaaatgcgtggacaagcagatccggctcaaggtactcaaaacaacgtctctgcctgacgtggcggctggagtcacggcagcaagcggtctcgttgcggttattgacgaaccgatactgcccccttacaaggagcttttagaacggctggaccggtctgggagcaagctggagcaggtatttgaggagcggtgtgacattgtgcgacgtgtccagaacaagctcgactacctggaccaggtaatgggccccgacactcactcaaatgaggactcttggagggttgatttggacggatgtgtgccgcccagactgacactagacgttttgaagggtgtggaggatcaattggaacgacgacaggaggagtatgagtctcgcaagtcgcagatcgactttctggccaccgagatcaacgagcattggagtcttctgggagtggaaaacaacgagctggacgaaactatcattcaccatcgaagcgtgccgttggccctcacaaacgcaaagatcacatacctccaagacactctcaaggaattgcaactcttgcgtgaggagcgacagaagacaattgagacatacaaggccgaagtggagcatttatggtctcgtctggacgaggatgaaggagttattggacggttcctgggcacagttgccggtgagacggctgttgttgtggaaaaatggcacgaggagctactcagaatgcgtcaacaaaaacaggctcacttggaagtgtttattgccgaagctcgtgataatctcaagtctatctgggacgccctctattactcggaagagcaaagacatgactttgtgccattctacatgacagaggactcgtcagaggcccttttggaggtccacgagaaggaaattgctgccagagaggccgagctaaccgagaatgaaggtattctggatctcgttaaacaacacaaacagctggttcaggatgcaaaggatctcgaagagtcgtctcgtgaccctgctcgtctgatgggcaagtctcaacgtggagatcctggtcgactgctgagagaagagcagatgagaaagcagattgccagaaagatgcccagactgctggtcagtttgaaagagagcctcatggaatatgaggaagagcagggtaaaccatttcttgtgtttggcaagtcgtatctccaggtgatgcagcaacaggaggttgcgcaaacacctcgaagacgtgcagcagcttctgtggcacaatcagcttctcggtcagtgtctcaatcagcgtcacgtggtggccccccgtctgtttctcggtctgtttccgccacttctgcaccaagaagtgctcaggcgtctccaacaaaaacaagaaacatgactcaacctatcacacggtcagctcctcggcccggggctcgtcctgtgactgctggaaatgatacgacgagtattaggggcaatctaaactctctcagaaaccctggacggccttctacggtcggtgcttctacttctagaaccgcagcaagtcgtatcctcggctctgtgcctcgaatgcaacctctacagaacatctcgtccaaccgaatcaacaaacccagcaccattcctggtcccaagcgaagatctcttaacaagaaactgaccgcggctcaggtgaaccacaatctcatgggaggtcaagagactccagttcgagaatctacgccaatgaaagacattagtgctttgcacgcccagagaaatgttcctgtctgggaacgtctttctcccaagaaggcggcagatactgagcctcggtcttcacctcagagatcacctcaaaaatcacctcagagaagtcctgccaagtctttgaagactactaattctcccatggtgaccataaagtcccctgtgaaggagtttgcggttcctaatcagtacattgctcccggatcggtttcttctacagttacaatgtctcagagccccaagagaagcccgaaaaagtacggacaattggacagattccacattggatgtccggaggctgagatacgttcagtctctggcagctccactacgtcgaccacttcttctgtgtccgttttctcggattcttgtgatctgccgtcgtcagatgaagaagatccagagtacgctgctttgatgatgcaacaacgacgtcagatttcaagaggcctaccgaagaagagatctgaccagcctcgtctatctgttttcaactgggataaggatgtcttctaatcgtcacgatgttttcaacttcaacttcataccccattaaccaagaactgacctatttattcactcatttatatagtcaatgatatttatatttattcacctaacccatgtgcaaaccacttgtcaaatctacaacacagtctccatctcaacatcatcgtcatcatcgtctgcaccatcgtcttcctcctgggcacctgcagaattggacagctgcttgtactcctgttgcagggagtatttcatggcataaggaccagacttgttgagaacagccatgctatcgagtacctctcgaaggtacacttcaggctgcttggttcgttccttaagacccttgagcgaccagtaggggtactcttcgaacagcttgaagaggatatccagaagcgcagatcgctcgatccgaacggcctttccgtccagcttgatatccttcttctgggccttcatgaagtgcgactgagagccagtgccacgcaggttgggggcattggaagaagccaccacgccggggaggtcgttgagcagagtgactcgggcagcaggaggctgttgcagtcgctcctttcgcttctgaatgacctttttgtaatttgcgtccttgagtgacggcacaactgtgcattcgtggattactcggccggccagcgccgttttcttggggattgttcgtgcaaatggaaatgctgatggctttgagacctttcctgctgacgatgacgctgccgacgacgacgagccggctccactactgccggcctcctccttttctttttccttttccttcttctgctccttctccgtgaacacaaacgtgttgttgaccacctccttgacgatatccaactcatactcatgtggaatctcactgttttcgggcgtatcacttaggcgcaaagacaccttttgtttctcgccgggagctgtgttttccttgatcagcacctggccgagtcgcttgttagtgtgttcatccagatggctccacttgtccaccaaaaacttgggcagtcgcaccaaccatacccggttttcgagtcccgcagtatccaggtcgaaagatccatcgtcggcatcaacaggaggaggaggaatcttaacatcttcctcttcgggcttgacctcagatttcacgttcatcttgtctgtgcgaatgtcgtgaggaaacgatgatggaaatgtatctatctcgatcagcgaaaccgccaaagtgctgaggttctgcatatatgaactttcttggtgaagtttaaatatggtaccgtaggtaatgtatggacatgtacctaatgatgggtgattgaagagttgcgggtatagtttttccgagatattcttctcgaattactggtatatatttgctagactaccttttttcagttttaatggtcattgcatgccccaattgtgtggtcgtggtgacagtttgggttgctctcgatggtcaactatagagctgtcaaacgagaggaataacagttggaaagttagttgaagtatgagatgctccaagttcgagttctgttcaagtcgattcaaacaaaagccccatcttgacaccagtttgggtcctctttgtgtgctataatacgagtattaaagaggatattaatcagcttggccagtaacgaaggttgaggaaggacttcggaaggctccaataccccattgttactaagcattaatgcaaagcattattactaagcaaaaaaacttacattgtcgccaccttagtaagctgcaaaaaacagagattgcagcacccaggattctcgtatggtctcccactacaatactaactaggctctctggtgcttgactatggctgatcggacgggaagccgtattttcaccaggatatggccgcaaccgttaggaccaaaaaccgttagactgttttgagaagacagattagtcacgtgatcgcaaaagttggtgtcaattttagaccctttgaagggggatttttggtataagaaagggatatgtatgctaagcatgactctgcgcatgtctctgtgccactcgcaatcaatgatatcgacgaaatatgttgaaattgagacatattatgatgtttggggtggattgtccaagttcccactgtacgcacgagtatgtactgtattctggaatattagcaatagtacacacgcaattgggcagcagaatgatcacaaatgtgcaattcaattgaatttgaccccataaccctctccgtatctctcgcgcgcacatctgcaccggatctccaccttcatggttccgtttcttcccgcatgtgctgctttgtcgatcaatacaatcagccgagggtcggcaatcacattgggcgttctcataactgttgatccgctagcaatagaggtcagctcacctttttgcctttgatctaacccagaagtctcgggttcaggcaccctgagacacacagctcacctatacctgcgcagcagagttcaccgccgttagaccgaactgcaatcaaagtaactttccgaggaagagttgaggggaatatgagcggtctgtcagtgagtgtagaagagacgtatgtaagaatacatgtacacaaggtcgagttcatcgatgtatcttaggtagtggcctcgagaagagattcagagctacaagatgttgtttctggacggcatatttcgagtgaaggtcagagttacttgcgcttaaaactaactagttctattgtccttgttgaaagttacttaatatgaactgaaaaaatcccattggttgagtgtgaggagaagttcggactaaagcaacgagacgtgggcaagagcgttacaaggatagtatggagtcttccaagagtgtgaaaattgcatgtttgtatcggaaaaaggttttctgactaagcaactgcctcgatttctcattttcaaggcgacttggtggtgtcgcctacctctccatatctggtcatggtcgtgcctcgataaagttggcagaggaaaaaaagaagaacgctgtttttaaggttggcacaaaatgtgttctgcagctgcatagatgtatgtgcagcatcgcaaaaaaacgctacttcattcacaacacacaaaaatggattttgcagcactgattcagggcgaaatctccaagaagaaagctggaacgggagtggcagactacggctgtaaggcagcggctcccaagcccgcccagacgacagtttccgacaactcagacgacctcaagcgcctggaacggctgaagcagatgaagcgacagagagaacttgaccgggaagaagagcgacttgagcgagaagaggccaagagagccaagcaggaatctttggccaaagcaccagcttccacaacatctaccgtatcgacagagcatgatgtggcaacatcggaaccaatagagacagtggaagaaatggctgccaatgacgcgagaacaaacgtgcgaatcgactggagtgacgtagccacaaagaaggatgccacaagggattcggagaccaagaaaaagctcgccatgcagctgagagtgtttctggcacggttattgagtgaatgggagggtactttggataagggagctgcagcccaggccagtggagcggccgaagaggtctccgaggcagcaaacgcttacaagcgacacactatcttcgaagaaacgcagacctctctatcttctctcatggtcttattacgacacaatggtctccaagacgaagttctggctatgctttcaaaggtcatgtaccatgtgcaacatgaggaacaccaccaggcctatgatgtctatcttaaattgtgcattggaaacgcctgttggcccgttggagtggcttccattggcattcacgctagagcgtctcagaacaagactattgcttcagcccgaaactcgaagcaggtggcacacattgtcaatgatgatacgaggcagtggcttgtgtgcattaaacggctattgacctttgctgagggctacgagagttgtgtgagaaaggctttgttgactgttgtggatatggaggatcgggggaaccgagtcaacgaaccgcgaggaagggatgtcaaggggacagtcctggaggaggctggggttgatggcaattccgagactgaccagaatgctgaggttgaacagaaggaagcctctgagtaagtaacctcctgtcctgtgctctgcatcatgggtcgtgtgttgattgctagagagaagctgcttccacccattaaattattaatcattgtattttttgcattttgttgtctgttttgtgaaatggttagtcagagtctcgccgggtagcattgtattgttctgtcttgcaatgtagagctacaagccgtgggattgcagtaaaccagatctgtagacaagagggtagcaagactcatacaagtagaactgccggggcacacaatacattttcggattgtgtcagctcttctttttgacttactgtccgtctgattacaccatattcgggttgacaatgtcaactcgttgcaaggatgtgttctgacagacatgacaaaaaggcatacaaaaccaaatgaggagcttggttaagagcacaagctagattgatctaaaagatttcattctttttctttttttaatccccctcctttcagatctcttgaagatgccatatctgttttccccaattggacatgtcaatagaatccatgcatggaaggtcaaaaatttcctgaacgggaacggacaatgaatcacagagatgattctagacaagaccagtatcgaagcaatttggtaatcacccaagttcattgacggatctgttttgaaacgtgaatgtgacaaagcctccctgttgccttatgtctataagtaacagtacaatccctcccgtgaagtccatcaaacagaaagaaccactactacaacaactaacacaatgagcaaggctatccctcgagcatatggcaccgactcctaccgagtcaactccaacgttacaattgttggcggataccgaaccttccaaccctcctcttgtgtgattgcctaaccgagagtcgagtttcaaatcgcacacatgttggacatatcgataattgattggacatatcaaaaaatgactacctatgtaggctagtagaccatgacgtagttgggcccgcgataacatacagagacatgctcttgaatcttggttctattacacatacctaagaatacatgagttgtactgtgcaagacaatgcctacaaagcccaccccgacgataatcaataaaacaaatgcattactctatcacctccttcccatcattgttccccattggccgtctactttcggttcttcttattactgttaacgtatcgtcctcgaccaaccttgacaccagtatgtctggtagcttctcgagcagaaccagtggcagcaaagggagacatgacattctcggcagagcctcctccgatccaatgatcgagaatcttctcgttctgtcgacgcttccattcgtcgctcttgatggccttggcgtactccttctggtcctctctcagcaacacatcgttgaactcgggctgtcgctggtgtcgactgttctttgactggggcttgggcagagtgtacttgttgcctcgggtcgaccagttcatcttcttcttgagatgcacctggatcttgccgtcgtttccaaccgtgacggaacatcgcatcagcgtgtttcctccacacttggggcaaaagtgcttgacgctaccgtccttgggatagggcagaagatggaaacatccatggcatcgcagcatggagtttcggattcgctgaatctgtcggccattggtagcgttcacaagaaccatgcccatcttgagaatgacgttctgcatggcaaaatcacccgtagaggtggcagccagaatatgttcaggttcgacatcgtcgtcaacaacctgtccggcatccttgataagcgactcctgcaagttctcgggagtgatccactctcctccatcactgtcgtcctcactgtcgtactcaaagggaatagcgggcttgtcctccttggcaggctgggtgagaccggcgttaccccagaaagtgctacctccaactttcttgccctgttttcggggagctctagactttttcgtcacagtctcccatccatcatcttcctcttccttcccaggctcctcctgctcgggctcctgctcgggctcctgctcctgttcctgctcctgttccttatcctcctcagactcgacaggctcggtatcctcagcttgtgtaacctcctggggctgctgcttcacagccttgagatgttcaaccccaccgtggagctcaacgtcaatctcgtatcccagagcaatcagagcaatatcggtggaagacaaaactccgtagtcaccggtcgatctggcgacatcggaaacagccttgacggaaccggccttgggctgtcgaatgaccagtcgatcgccccatagcagcaggttggctcgagaattgtcgtccttcagctcggtgataactgagggagtggtgtagaaatggtcggccatgttgtggagagtctggaaggattgggtgataagaggtcccgcatcgagaaccaacgagttaatctgcttctcaccggaggctgtagatgccggcgtcacgggtttcacttcttcagcagacattttgtatcaataagggattccaaaatggtttcggtgttgtgtctgttcaggcaacaattttttttggaagaatcatgtatctccatgcatcgagagcttaatttgggactaacagtgcgcttagtaagccaatatgagtaggactcgtagtgactgttggtccagccttctttggcgtggaagaggtccaagtgatggaaaagggaattattatgctctcagttctcagattctcctttttagaaacccctaatctgtatttgatatcataaaaactgtcatctctgaggaagacgactggcggaagaatgataaggttcccacacacctccatagtcaacaccatcaggcctgatatctgtaatggaagctcgtttatttgattttgattctgtaaagctggtgttgaatctgactaaagtagccgcaaataataccctgaaaaaatctaacgcgattagaccaatcctgggctagttctggcgatcatattgtatgaaatccatctgcaggttcgagtttcgtgcaggttcgagtttcgtgcaggttcgagtttcgtgcaggttcaagtctcgactgtgatgttgaattagacaggcgtgatcagtctcaactcattgtgaaaagaatggcgatttgcacggcagtacttgaacttttggtactttgaattgccactaaaaagttttcgacgcggttactagggagtgccttgaccactcctctacttcccaatcaacccaacaaacttttgcctcacatattgcatgcaacacagtactgtaactaacaactcacaaccatcttcagttatcatagctaccacacacgtacactccaacatggctgatagcgcgcagaaggcgttcgatgaaaaacgatatgtcgactcggtcaaattgttcaacgtgttcatgaaggatcatcccaaacggaccacccccgaccacttcctactccgatctactgctctccttcgactgggcaaaaaagaggctgctctgagagacgcagaccgagcaactcgtctagcatacgctcagaagagcaatgaggcgcttggaaaggcgcagatgagacgagcagtcacctatgtgtctctcggagacaatgctgctgccaaaaaatgtgtggactttgcagagactgccaaccccgaagagcgcactatccctgtatggaaggccaagattggcatgagcagcggttccaacgaggcgtccgacgtgccccagattcccgacattgacatctcctacgtttggaagggacccacagacgtacccgtgaaacatgaggtcaagcctgaggtcaagaagaccgaggccactgctacgaccaacgacaccaacaatgagactcagacaccaaagccttctgtcaagcctgctgccactcaagagactcccttcaaggtccctacttctgagttcaagtttgagcccaaaccagatgtcaagtctgatcctatgcctgctcctatggatgattctaaatccaccgcgtcttctcggtccgatgaagccaacacctcttcaatttcatttaatggccccaaggaagacctccgcacagacttcttccaatccaacgaaaaaatcacagtgtcgatttacagaaaaaacacaccaaaggatgcaaagtgcgacatccagcctacatccatttcgatcatctgctcaatgtacagttggagcacccagttgtatgcccccattgtgccctctgagtcctccgtgcagatttacggaaccaaagttgatttcactttgatgaagaagacacccgcaaaatggcccaccgtcagtggaaacgcatctctcaatgatgattcggaaacccctataaagtctcctagcagcaccacaaaatctggaccttctcagatcactaacatcgacttcttccaaacccctacacatatcaacgcctatctctacatgcccaatcttgtcgagtacgagcctgcagtgattggcacaccctcaagctttacggtcacatttactaacaacaacgatcccaaaaattcgtttgtaaagactgtctttctgcatgggctcatcgagcctgagctgctgcagttcaaggtgtaccccacgaagctagaggtccagatgcgaaagaagacgtctggaaattggccttctttggaaaagggggtttccaacacctcttcttcggccattgctcctcccacaacaaaagattggtccaagattcagattgaagacgactcagatgacgatctgaactctgaaaacccagacgactttttcaaggctctttatgctgatgcagacgacgacacgcgacgtgctatgatgaaaagtttcgttgagtctggaggcacgtcgctgagtacggattgggacaaggtggagaagggagagcatagctagactatgatgtagatagtgacaaacgtgtctttcaaatgatactgtctttcaaacaaggagctctgcgtagtcttgtatagatgtgcttaggtagccatttgtggtacagtacatgccgtacactcgaacgatacgatactgtatattggtgtgtaaccgaaaaggatcattcaaagcagccattctgaagcaatggccgttaaaacagctgacatctaagctccaccttgcgccaccttgcgcctttctattgaacctccctacttgggttgccggatctggacaagtcaatagagctccacgcaccctgcaagcacggaagtattcaaacaagagaatgtgattgatactggagttgatacagtggatgctggtgttaatagccgagatccccgcagtgagcagccgttattaggtcgaggcccgctcaacagaggattatatataggttcttgcgacccatcctaaaagtaccaaacaaccacctctctccctacaaccaccgtcaccatcattaccactatcaacatgagcaaagctatccctcgagcatacggcaccgactcttaccgagtcaactccaacgtgaccatcgttggaggctaccgaacctttcaaccttcgtcctgtgttattgcttagccaccaaagaccttgaactaattgattttctagtattatacgcgagcagagcctcattatactacctcgtagacaagaattggttgggtacttgtggatcacgtccacaattctccttcaacaagtgttacaatctatcaattatatatactaagtgtttaagccttgctgtcagtcttcttggcggcctccttgacatcggggggagacatttcaaagaattcctttgctcgctcggtctcggctcgctgggcctctcctcgagcctcctccttcttggcctcttcctcgtcgaggttgaggtcatccttgacctggatgatatgtccagactcctcctcctgctggttttcctcctggatcagctcctgctgttctcgaacaacctccagacgctgcttgttagtagcctggtcggtagcatgggcatactcgagatcggcctcgtggaacagctcctcggggatggcagacagaacggcctccagagcgtcgtaatgggagttgagatcatcagcctctccgtaggtgaaggcagacgatagaatgagcagggtggagggcaccttctgtctcagacgcaactccagccagttgttgagatcctccgcaagtcgggccttggacaaagcatgagtcttgatacctcgagaggcacaggcgatctgaagctcagtgagagacagagagtcgactccctcggcgtagatggctcgatcgtcaatcttaatctgtcgcatcttgtatcgaatggagtatcgcagcatcaggttagttccaaagtgctgcaggttcatgtacttggccatagccacaagctggggtcgggacaggttatcgaggaccagatcatccttgaacatttgagcaacggaaatgagcagttctcgagagggcttctctccatgggctcggaccttgtcgaagaactcgacgaactgctgtcgctgttcgggagtgatggaagtgggggcagtaagaccagactcgttgacagtgtccttgaggaaagaagaaacggaacctcgggtctttcgcaggcttcgggctcgcttctcgatatcgttggaagacatgtaagtggaggggagcagaccggggaagagcttaagggcgacagggagcagcagttcagcaaaggggataatgaggaacatggcgaagggaacaactcggacaatgtcctgggtggttcgcttgagctgtcgcttttctcgtcgggtcagttcgtagccggcagccagcttcatggcgagcttggaggacaccttgatttcaaagccaagcagcttggttccgtcccagtagtgtcgtgcagcctccttgatggtctccttccaggttttgggggtcttttcctccttcttggccacggctccgtcagcaggagcagcagcagcagcaggagccttcacgtcgctcttctgctcagcagaagtggccttggtgttcttttccagattggccttggtctccttggcatcagcatccttggtctgatacacgacaggtcgcgtgtggaaacgtcgagtagcaatggtgtgagtcgtggcgacgacagtggcccgggcaagctgctgtttggtcaccagaccgagatatcggttgattttcaccgagtcggacgaaattcttcgaagcatggtggtgggtgggatcgtatgtgtgacgattaaacgggtcgtggagctgggtggagtcgtagtttcaaagcaattgattccgtctcgattccgtgtacgctgataaaggtcgaattccaaagggtttgtatcgttcgtcgtctagcccaatagtgagcttgcgggtttcgggactcggaattttcacactttacctcttagttaattttcaaagtttaatggctcaccatgcagcaggtggcaaacgtgtgccatggctgtgtttggtgtattgagaggcctctcggcctttggctcgggcaatctcgaggcaatcaacggtccaatgtgtagttttttccttcctgtcgccaccccaacaatcggtttgtgtttcccagggccttaacctacaaacggtataattacgaaatatagacaccccacgtgttaggcgtggagagttgatttggaaggtgtaaaaaagtccacctaagacgaacgggctggagaagggcccagatactcggctcgcaggcgcccaatcggcattgttggtggcgcgattacataagaccatcatctggctcctcgtggttggccaactctgatcatacagacgtgactgagacctgcgagaggcattgtcaggcgtctgaggcagcacaacttagtggacagcgagaaaggcgtgaaactgatttgtggggggagagatagagatataaatagaactcgggtggttggtggggtgggttttcagactctaaacgcttctcgggtatcgccagtggcaccattggcctttctctatgagaatttatagacctgcaatagaccccacagcagcaacttcagcatgttgcaaactccaaggggatccaaatgccgattgtagatggttattaaatctgaaaaaatagggagaaatatccagcattcctggagatatataattctcgatcattgcccaattgaaaatctttctgaatgaagcgtagggaaacatctgtctctcttgtataataccacactagatttagaacttgatggatagcattttccagggcctcgattgacatcctctaccggacctttggttcgtcttttcggactttgaaagctatcgacaccctccccgcaattgtaagattttaatggttgtgtatttctcactccggcgcgtatatatatctcaagttcgagctcctcatgtcagaaacaccgagcaccgcccaaccacacacaacgcatgaactgtacatgctaattaacaaaaatgcaacccactgggcctgacttgcgacgcaaggaagaacacccgaaatccccgttcccaggccgctacgagctcggtaagtacattttcgtgtttgtctcgttcggaaaaccccctctgtcggttccgattaaggcaattgcaccaaaataatatcgcgccaaggcctatatgaagatgagctgcaccatctcggtgcatctgcaaggctattgttcaacatacctctgaacacacttgtgcgactcgcatttctggatcgtgtggaatcggaaagaaaaacggaaagaaaaaaaaaaccacgtcttcgggtgaaagggattaagtcgggatgcgtgttgattggcctgatgcgattgcgacggacggtgcttgtggcggcttaataatacagctaaaccagacgctaatagagaaagttgtttatgtaatttgtcaacagcaggtcgattgacactccactgtcctactctgttcgtctccaaagcgaccaccctcaaaacggcccaacaaaaaaaaaatacgtaaaccaaccttattttcaccatcttggtggcactcccaaaacgactcagccaagcaaaatcacatgtttgaaccttaataatcacggtctatcgtgcagaatcgcgaatatcacgagtatctcgtccccaacacaacaaggcaaacaccatggacaaaaatctccagagtctacaggcctcgtcggagtcgatacagacgctgtactttcgaccgccgtacatgttcaccaattccgtcaccacaaaccccaacatcatcgacctcattcgcgacccagaaccagatgaagcgcgtcttttcaccatcaacaaagatatggtacctgagctcgacgtgtatcagggcacgagtagtgcgattcaagccgccaaagagatcagacgggcgtatgagaagagccgggaagtcaacgttgatgtggtatgcgacgcagttgacaacctgaccagatcataccccatgccaggagtcgaagagaagacggtacgattgcggaaaaaggcccatgatctggcagcctctgttcacagcttggagagcgtaattgaagaccaggagcgtcagttgaagaagctcgatgctactcttgagaacaaaaagctacagccctcgttcctgctgtcatcacgcacttttggtgtcccttccttaggaggtggtttgtccgagagattaccacgagacaaggcgacgtggcagaaacaggtggacaaagagaagaacgagattgagcagctgaaggcggagctggctcgcaaacgttccgaaatggagtgattgtttgcgcaagcattcttcctctgtcaccaacttcatcaagtccatctactttcacatcatcaacatgaacataatctgaaatgtctacataccaccttttcaggcagagacttccaacggggagatctctttatttattcaatcaaatttataacccattaaaggctcgagctacagtagagccaagataatccctgttcatggtgacttctagttagcctcttcacagcttgttctaaaaaagaatcaatcaatacataatttttacaaatgcacttcgtaagtcgtgatttactgcaacttgtcgtccttcttgccctcccgcaaaagccgtcgcttcttcttgacaatgtagttgttgtaggttcccagcaggaaagaaaagagagagaaaaagggaacccaagcgtgctcgggaataaaggcctgagcaatagccagcacgataggagaagccacccaagaagatcgcagtacgggcaacagagacaccttgagcgaagcaatgacggacttgacgtcccgagcgccagcaaagatggacatgaacaccaggaacacggtggatgtgatgggagtcacagtcagcagagatgtgagaatctgagccagcttccattggatccccttctttcccttgaaggcagcctgcagagcaccgacaaggtagtgtgacagcggagcggacacaaagaatccgtagagacccatcttgtagattcgggatgacagatacgatccgttagcgtccttctctccagcgaagtaggatgccaggaactcggccaaagcgttgagagttccagaggtgcatgatttggtgctttgttagtgaattgaactgaggccgtgggtattagatagaagattgtagcatcagatcattctttgtcagcaggatggcgaactctctcatactagacgagtcggtcctgatccttgtagacgtggccactatctctttgcaacagattagtcatcggtttgccgaatcgcaatatcaattagtgatccacatgttggtgccgaggagataggagattggcgtcaacgtcgggtagcccggcgtcccgttgcggtaagataagataagtaatgatcctatcaataattgtcgtgtcgagtgatgacatatccgggacaataacagatcacctaatctattcgtctgatccagagagtcttggtcacgagataccacctcctacgattcgttgacgacccgcaatgtcctgcgtttacaccttcaagcaaacatcagttgtacccgtccctcgtagtccgttttcgggccccatgatggagcacgtcatctgtcgtgtggagctgtgtccaagggtaccattggaatcgtgtatactcacagaatgggtcgctgctgcagagacagcaggtactgctgcaaaagagtcgcttcggcgggagaaagaggtttcgacatggctgctgtgacgtcccttgtacactggtatcgtagcagacgggggagacagagagattataagcgcgggggaggaaagataggctttctccgaacaaggccgtagccccaaccctggcgagagtggggaaaatgttggggggaggtggttgtgggtgtcggtaagggtgggccgaggcgggtggtattttcctgtgttgctggcacttgtgggagcaaaaacatgtctttcatgttgttattcacctactatacaccagtttatgggacgtcttgttgctcctcctacatgttcccaatatgcgtcagaagttcccacggagaaacaggaagcgaggtttgaactgtggagaagccgttgaaacggaattggcgcatggccgttgtgctccgaattcccgtccaagtaaattccgatctttgttttccgtatttcgcgccccacacccgtttttttgagatcatattccaacttgacccccacgcaaaactatacaccagacactcaggttggctgcacggagataaccaacttgcaccgtatccgcagcggacaaacgactcaggtgaggcccggaaaagtttggtctttccgataacaatgtacacttaccctcgggcagtgttggcttcaaaaacaccaaatatacaagttgcaaagccacagttatgatacctgtctatccttgtactttgtcgtacaatgtaaacgatggatgctctttctagagccgccaatagttggataaaagttgagagaatcgattgaagaccctttgcatgtttcattccaacctcccacatctcaaatgagatcccacacacacatcacctgtacatccaaaaagatccatgtcgctacttgtaccatctttttttaaggtttcggtatcgcggtatctcttccatgattgtggggaagtctagaagatcacaagtaatagatcaaagacaatttgatcgcctcttgtatagtgtttgggttccgacaacgggcagatgaactttctcaagaggcgcggattggaggtggcaatcacgtgaccacacacgtgccactctcctcggtccacgtgacccatcattgccgttgctcttgtcgtatccctttcggatgcatgtcggggaatgtagtgtcccgatccaggcattattgattagtcgggctttttgagcgttgccaagcccgtttcttggagtgaatgaaacttttgtaacttgtcagaaatggaggtaagtagagatgatccacaaacattgcaaggacatttgaaatatgacatcgaacggtcttcttctatccggcgctgtcggcaagtacattatgagtacagtacattatgagtacaagtactgtggtgatatcatgtgccgggcaggtggtagttcctcaagtatggtgcagatgttctgagatggtaactcgactgggaatttcgtctgtgtctgtatctaacacacctgcatctatttgtgtctcgttattatttttgtcttgttttatcacattttatcgctttttatcgctttttatcgctttttatcgctttttatcgctttttatcgctttttatcacattttatcgcattttatcgcattttatcgcattttatctcacatgcttagttattgggaagtcgaaataataccctcaaaatgattcaatggtcaagcgtgacatacccatcccaattaacgaaaatgaactctaaagacactaatacccacgtgacttactccacatatcacgtaatgtacctcctatcaccctttagcccgtgtatcgtacgtccctgtgctgtaccttacatgcgtcacacactcctccaagtgcaattatcaaatcgagacgattctccagcctctcccaatttcacgttgaactttattttgctgacgtaagcagtcctctgcaacggatgggtttgataacatgtggttccaggtggtcaatgggtgagaaatttcaacagcagatttaaaaaaactgtttatttccatcccattgatttccaaccaagttcttcgccagaaaacatacatttcgccgatatcaatctcccctaccagattaacctctggagttaccctgccgaagtcgcacaagccagacaacagtaaacggtatacgcgacagctcgcagttgtacgcgtgaagacagccccgacttttgcgacacaacatgttttccgagggagattttggagccggcggcagcgcagacgcccccaatggcgcccccacgtcgaccgatggcgtctccagtgccgctgcgcccgtcgacgacctcaatacgaccgacaacaattccatcacagagcccactaccgcaacctcagcgacttccaacaccgaggccacggctgagtcgatggagcatgccgagcccgtgattcatgctgacgtggcaggtggtgatgagcctgcccccgatgttgatgctgttgctgacactgcacccgttgaacctcctgcgggtgctgatactcctgttgacgctacggctcctgtggagaccaccaccaccaccaccaccaccaccactgtgaccgaggagcccgccacagacacaattaacgacggtgctgttgttacagagaccacctcttccactaccgagagtcttcctgctgctgagggtgctactactgccactgacactgctgaagaggccgcaaacggtgcagatgcagatggtgcagcaaacggttccagctctgaacccaagcctgagacctctgagcctgctgctgccacgtcacctgcaccggcactgccctcagatggtatggatgtagactacatgcctgcggaccaggacgacaaggaggatgactggaacatggacctggagcctgagtgggaggccaccggtggaatcgccgagaccaccaaagtcgagcccaaagcctccgcagagcccagggacgacaaggaggctgactcggagatgcttgacgcagacacagccatccccgacgaccaaaaactcaaggagaccaagcccgtggtcgccccaccacccgtgccccgaaacgcggtgcccgattacatcccccaggcgcacactattgtgatcccgtcttacgccagctggttcaacgtgaaccgcatccactcgatagagaagaaatccattcccgagttcttcaatcagcgcaacaactctaagacacctgaggtgtacaagcggtaccgtgctttcatgatcaacacctaccgactgcaccccacggagtacctaactgtgactgctgtgagacgaaacttgctaggcgacgtgtgtgccatcatgagagtgcaccagtttctcgaaaagtggggtctcatcaactaccaggttgatattgaggcccgaccccaaatggttgcccctccctttacaggccactgggaggtgactgaggacatgccacgtggtctgttccccttccaggcatacaggggcactcgtttcctgaaacgggctggcgagaacggctccatcgaggagggtggctcgattgaggccaaaaagccgaaggtggagggtgatgatactgccgatgctgtggatggtggcaacagcaacgacaacaaggataccagcagtaaagagggtggggccgaggtaggcacccagggcgacacagtgcgagtcaaacccgaacccacaactccccaggttgagccatttgtgcagtccgatcccgaatggactaagcgggaggtgtacaacctgctcaacggtatcgaggagcatggaaacgactggaccgccatttccgagacagtcggcaacaagacccgggagcagtgtctgctcaagttcatctccttgtctaccgaagacaagtatctgggcaagagtggcgatgtttcagcgtctacatctggccaggacatcaaggtgtctcctcttcaggtgagtcccaagtacctgccgtttgaccatgtggataaccctgttttgtcggtggtttcgttcctgactggtcttgtggaccctactgtggtgtctgccatgaccggtcgaggtgtggaggagattcgaaagaccctcaaactcgaaatgactgagcaaaagaagcaacagctgctggagcgaagacgaaagcgagagcaggaaaagaaggataaggaggctgctgctgccaaagatggtgacagtaaggacggtggggagaaggaaggtggagaaggagataaggacgacaaggacgccgtcaaggaggagggttctgatgatgacccagctctgtatcccccgggagcatctgactctaccgatgccggcacctccatcaaggacgtgcctcttgagacgctcacgtcgctgggctactctaccctgggcaccaaggcgcaggtctttgccgacttttccgagaaggaaatgtaccgggacatgtttgagctgaccaaggcgcaggccacaaagatggagatgaagatggaaaagtttgccgagttggagcgcatcatcgagatggagcgacggcagctgcagatggagcgtgagcaggtgttcctgcagcgtctgctgctcaacaaaaaggtgtcgcaggtggacaatctgcttacacaggctgctgaggagaccaagaaccagcaactgattgaccaggcccgttccattgtgcggggagccaccaagctgtcgtttgcacctactgtgcaggaccaggcgctggagaacagttgtgtggaaaactcgctggacaatgtcactcctgtgacccagaagaagcagacctttactttctggcaggcttaggtctagggagacagatgaggaggaatacagggaggcgtgttgctaacggtgaagatggttgtatattaataaattgtttaattgatgtcaagagaggagcgagaactcacttggctatagtacgatggcgaagtggtgatagttgctggccaaactgtgctgcatatcctcatgactggtcatcgggacactgtagagagtgttttattgtgtctattgacgggtcatgtggtttcaaaaacaaaacaaacgtttgtaccgtcgtgagatactgctattgttagctactcttctttctctatataatgcgttgtgagatcggagtgtccctgccacgactcaaccatgatcgacaaactattagaccagtacattggagatgtgagtttttcgaacgtttattccgccgaggagccgtggagtatctacgacgagtatcctgagattccgccgcgtgttcaaccagtggagaattctctgattggagacttggacaatttcagtctcagtgtaccttctgagatttctttggacgcgggcggtttggaaatcacgtcatcggtcaccgttgtcaccaagagagcggacagagttgcaggcggtcagactctctatggagacattctggggagtttgagtggtttggatgggtatgggcaggctggttcagagagaactcatcaagtgacactggagaagtcgactgaagcagatgggctgggtaagagcgtgttggaggagctgtctgaggaagagaagtttgaggccacgaaggtcaagggcgaggaagagttagtacaggacacggacaaggtgtttggagctcccgatctcgccatttacaagaagcggtttgcctacggcgagaaacttgtgctggccgaactcagagctaggaagaagaggttgaagcaacttattgagcgcatctcggcaaccaaatccaagcgggagagagaaagaaccaatatccagctttccctgtcgcctttttatgcctgggccgacgaagatgagttcgatgaggagcttgcccgctgggatggaagttatgatgatattaacgctagtagtggtataagaagaggtatttaatattgcaattgttgttattccactgattaaaaaaatagcttgctacgagtacagtacccgtactttcacttgcactcctactgtatataccgcatttgcttgtagagttagactcctacggacagtccaactctctcaagtcaccaagtacaagtacttgtaaatgggagccatatactgctacggaactcgtctctaaagtctcggctgtcttcacatgtggcctgcgggccgttgtgctgcgctcgtgcttccgttgtgcggcgttgtaagaatgtggagacgatgccgtggtcgagagaaggcagcgttcttcatgagcagacacgaaatgatactcgtcgtcagtgatgcacaaacacattgaacgagttgtttacattgataccaaggcattgataccccctactgccaaactcgacatcccttactgaaacccgtccgtcgagcacaacatcacgcacatcatgcacattatgcggagagccgctcagatcggagtatactcgatcctatccacggatagtgctggtgttcttgtgcggcgggagcttctggattatgtaagaccattggactttggtactttcgtaccatatataagacgatcaatcaccctgttcagtctccatcaaacaacacccatttcaacattacatcatgaaggtccttcttattctctactctgccggttctcacgccgttgacgagcccaagctactcggttgcactgagaacgagctcggtctccgaaagtggctcgagtcccggggccacacgcttgtgaccacctcttcaaaggagggagccgactctgtgctcgacaaggagattgtcgatgccgacattgtcatcactactcccttccaccccggttacatcacccgagagcgaatcgccaaggccaagaacctcaaaatttgcatcactgccggtgttggttcggaccacgtcgatcttgatgctgccaacgagcgagatattgccgttctcgaggtcactggctccaacgtgcagtctgtggctgagcacgttgtcatgaccatgctggtcctggtccgaaactttgtgcctgcccacgagcaggtcatggctggtggctgggacgttgctgctgtcgccaaggactcctacgacattgagggaaaggtcattggtactgtgggaggtggccgaattggtcagcgagtcctaaagcgagttgctcccttcaaccctaaggagatgctctactacgactaccagggtctgtctgctgagaccgagaaggagctgaactgccgacgagtcgagaagctcgaggatatgcttgcccagtgtgatatcgtcaccatcaactgtcccctccacgagtccaccaagggtctcttcaacaaggagatgctctctcacatgaagaaaggtgcctggcttgtcaacaccgctcgaggagccatctgtgtcaaggaagacgttgctgaggctctcaagaacggccagctgcgaggctacggaggtgacgtctggttcccccagcctgctcccgctgaccacccctggagatccatgcgaaacaagtacggagctggaaacgccatgaccccccatatctccggtacttgcatcgatgcccaggttcggtacgcccagggaaccaagaacattctcgacatgttcttctccggtaagcaggactaccgaccccaggacatcatctgcatcaacggtcactacggaaccaaggcctacggtgatgacaaggagcatgctaaaaagtaggctggacgtcgaaataaacacattgttcatctctgggtagcccaatagtaaataggtaagctgtgatcattaagccagttgttttttgtagggagatagtacattgtagaacccattatgttcaatctacacaacttcttacaacgacttactagtaagctatataacgaccgactactttctatctcatccagttccaatttcatataacatgcctgtgttcgattgcctacaaatatctgtccacgttggttgtcgtgtcctcgttcaaagctaagtataatctttaactaaacattccgcttcccaagtattttcaactagtttaaagttcagtcttatgcccaattcgtgtcagcctccagaatgtgtttggggcaatattttcgaaatatgagttcacagataggtttctcttgccgtatacattgtttttttccaaaccccagctctctacgaggctcacaccactccattaagacgcttccaccctcgtgccctccaaccctattctcccctaacccccatctgcatgaatttttcaccttctggcataacacacaccacacaccctcaacccccaaaatgactacgactcgtgtgtgtatcgactcttcggttgctctcaaaatcgtgcggcactgccaggaaagcgcgccttccattgtcgccggtcagctgctcggtttggatgtggatggcgagcttcgaatctcccatgcctttgccttcccccagaatgccgctggaggcaaccccaactccgacgacggcctcagcttgcgtcttaaggccgtggccaagtaccagcccgagatgatcgaccatctgaaggaggtcaacgtcgattccaacagcgtcggctggtaccagagcactgttctgggccgaatctacaacgcttcggttattgagaacctcgccgtgttccaggagaagaaccccgactctgtcgttcttgtgtacgatgtagccggttccgaggttgtttccgacaccgatccatcttccaccggcccccagggacataccaccaccaccccctccggcttcaacctgcgagccttccgactgtctgaggagtacctcaacgtgcgaaaatccggcaagttcgacaccgccaccctcacagagaacaatctaacctaccacgatgtgctggtcgagctgcctgtggagatcaagaactccaatctggccactctgctgctgtaccagctgggccagcagtaccccaactcgccctttgccgagtcctccttctccaacctcaacgtctcagttgaccccttccttgagaagaacatcgaggccatcttcgactcagtcgacgacttccactacgaccagggtaactacaattactaccagcgacaaatgacccgagaacaggccaagatcacccagtggcagcagaagagaaaggccgagaacgcggcacgagaaaaggacggccgaccggctctccccacagacgagtggaagcggctcttcaagcttcccaccgagccctcgcgacaggacaacctgctgatttccgcgcagctcaacgagcactgctccgtcatcgaggagttcggtgctgccgtcaacagcaagctgtttgctacccagggaggactgctttagaggtagtatgctagagaggatgaaaaatgtgtggatagacaacacacgacaaaaggatggattacagtatgttagataagcattgataagaggcaagcagagtgtagctagtgtgatattccgagatattgcatgaatagtacttgtggtagtggttgtggttgcggttgcgagtccaggacagaactggggctttctacaacattaccaaatcaatatccctcctgtagcaatctccgaggtacttagattgtagatgataaatcgactataccatatacagtacttgattgcctcgaagtagcatctccgagacgcactaaaccgctatgtactaaggtcgaatgaccgctactacaagtacagcgtgtatatagcggggggaagagggcgtcaaccgcgggttacttggtttgtaatctgtgtccatacggctcggatgctccacatgtgttggagattgagcagttcccgagacatcactagcccagctttccgacaccaacaatgacattgtcgctacgctaaagagatgccaactccgagtgggtaccagtgccgtggatctaggactccaaggtttcgagattggttcttgaacgcctttagtttcggatatccaccatcggagccgagtacaatatcggcattaaaagtggtccaagtacagttcttgactgtacctatacatccccgacctttaagagagctgacaagacatgatcaacctcctacaactcaccaagttcatcaaatatgttccagcagttttctcttgacggtccttacaagtccctcgcaacccccacggaataataacactactgcgcttctgttgagcggggtatcttagtctctcagtggactggcatgttgtctttcggaatcagttaatgaaccaacttcgacactaacataatgatatctactagatactggacaaagagcgcggcttctgtagcctgccaatggacataaatagatgataacgactcatccgatgttcctcaagaatgatcttctctctgcaactactactgacgacggcactagcggcctcttcgcctgactggtaccccacacccgaaatcggttcaattaccagtgattgggccgatgctcttggtgagtccatggacatcctggcccaattgactcttcccgaaaaggtcaacatcaccaccggtaccggatggagaggtgggcagtgtgttggaaacacaggggctgttcctcgtctcggaatcaagggcctgtgtctccaagacggtcctctgggcgtccgttttgccgactttgtcaatgtcttcccttgccagaacgcaatggccgccacctttgatcgtatcctagttcaccaacgaggaaccgctattggacgtcagtctagactcaagggagtcgatgttcatctcggaccagtggtgggacctcttggacgacacgctaccggcggaagaaactgggaaggtttctcccccgacccatatctgtctggaaagctcgccttcgaagcaattcttggagtccaggaagagggagttcttgcaaccatcaagcacttcattggaaacgaacaagaacattaccggcgagccgaagagtggagagacggctttggatttaaagacctgaaggacgccgtctcttccaacattgaagacagagctctacatgagttgtacatgtggccgtttgccgatgctgttagggctaatgtcggctcagtcatgtgctcctacaactacgtgaacggaacccaggcttgccagaacagtgacttgctcaacggaaagctcaagtccgagctcggtttccagggctttgtcatgtccgactggtttgctcagggaagcggagtgtctaacgctctggctggaatggacatgagtatgcctggaaatgacgttgatgagttagaaactgtcttctggggagaacagctgacccgaatggttgccaacggtacccttccagaagcccgtctcgatgatatggttctgcgaattctgacccctctcatctactttgggatcgacgatcgaacacccaacttctcctcctttgtcgacactacagtgggaagtccccaccccgctgctaagcactccaagaaagtcaaggatgttatcaccaactaccatctcgatgtgcgagaccagtttgcagccaatgttgctcttgatagtgctcgaggagctgttgttctgcttttcaatgacggtattcttcccctgaagaacatttccgctattggagtatttggagtcggctctagacttggccccaatggagctgtttgtggggaaaacatgcagtgctcagacggagctcttatcgaaggatggggaagtggaactgcttaccctacggagtacgaaagcccttacgaagctctccacaaaaaggcttctctacttgaagtgtcagtgacaggaaccaccgagtcatgggatatgagacttcctcttgagctggctggagacactgacgtgaatattgtttatgtattggcaaattcaggagagtctactgccaacgttgataagaaccttggggatcgccgaaatgtcagtctatggcacaatggcgatgaacttattaatacagttgccagtcagggacagactgtcgttgttgtcactacggttggacaagttgacatgaccgcttggctcaaccaccccaacatcagtgccgttcttctgactgctcctgctggtgattacggaggaaaagccatcgctgatgtgttatttggagaggttaatccctcaggaaagctgccttatactatcgcagcaaatacttctgattatattcctattgtcaccaagatccctcgagatggagctccccagtccgactttgtggagggaatctatcttgactacaagtggtacgacaagtttgaaaggactcccctctacgaatttggttacggtctgtcatacaccacctactccttcagcaatctgcatcttgatgttaaggagattagtgagttccttcctccccggcctgttcctgtacaggttactaaacccaagatgaccaatatcgacattgaggacctttatgtccccaatgactttaaaatgattgacggtcttgtttacccttggattctcaacgccagtgcgcccctcgcggactctcagactcagttcccctttgcaaatggagctggacatgtcagtgacgcttctggaggagtgggtggtcacccctggctttggtctaacgctgttactgtcactcacaacaccaccaactgcggtgatgttgctggacgagtagtttctcagctgtacgttgccttccctgaaacccttatcgactctcctccggtgcagcttcgaggattcgacaagtccaagctcctgaaccctggtgagtctcagatgaccgagtacaacctcaactggcgagatctggccatttgggacgtggaactgcagagctggagagtgcagcgaggcgagtattccgtgtacattggtcattccagccgagaattcgagctatgtgagactttcactttgtagtagtcagtcacccgtattaactaatcaataaatctattataaatgcatcccaatccttctcttttatatatccctctagttctttctcttcatctcgaccgctcgcttgtatggtgggcaagtagggctctgaacggggtccaagctgactcgaactccctctccactagggagagtgtaagtagcgtctgagtcgtactccgacaggtcgccacaggccacaaagggagcgacgacccgctcggaaataggcagagggagctccttgttgaccatgacgccagtagcgagatcgggagaccatcccgatcgaggcttgtatccctgacacacgatgaaagactcgagagaagagcctctggaagatcggggctttgcacaagtgacctgctcgaacaacagacccagctggaagtacatgagatcaatatctcgtcctcggaagattttggcgacaaagtttcctccgggtctcagtagctgggtggtcagctgaagcgcagacagaatcagctgtgcctgtgtgtactcgtcgagatcgtgcagaccagtgacatcgggagctccgtcagaacacacaaagtcggcaggctcgcctccaaactcgtccagaatcatcttcagagtttgaggatgcgtgatatcggcctggatagtggtgacaccagcaatgggagccatgggttgcagatcaacagacacaatcttggccttctccatggtggatgatttttgagcagtagattccccggtgacaaccttgcctccaaatgtcgacccagccaccgtcttaccgctgccagcctcgatacctcgcttctcaaacagctctctgctcagcacctgactccaggacccaggagcagcacacagatccacaactcgctgaacaccgtcaaacaagtggaactgctgatccagctgaagcagtttgaaggcggatcgcgctcgccagccctcctccttggcttttcggtagtaaatgtctctcttgtccttgctgctttttcccatttctgtcgagtgtagtcagagtgaaaaataaaaaagctaatctgaaagtttgatagtggtggtgatgcgaaggcgggggtctacaatgtctacaatagttgcatttgacgcggctttctataaaaagaagtgcaaacagctctgtctctttaagtgctcaacaatcgagtccatttgtattttcagctagtgcgtttttttttgcatttctgagaggtattattcttactaatcgaaggtggaaatccaaactgactttcttataatttagttgataattagttaagaaattaaaaactctaatatgcacactacaatgccctcgaagagtctacagactgtatattctccatctttatggtcagccaagtaactagtacactacttggacatttctcatctcatcattacacccttgtctgtcaaattacgggagagcatttgtaatgatgcatgcatttaggttcagagagcgcagtgcggggtgttcagagatgggtcctaaaagtgcgcttttaatcgacaatttaggagatttggccattaatattactcagcggacctttctgtatcatgtgacatccatatttcacctctgcaatgcttactaagtcaactaattactctccttgtcccctccgatatttgccccccgataacctacttgttcggttgggactacaacctaaaccaccttgaaacatcaccactgcaaattactttttccgcatcaaaaactacacacacccacacacacaatgctgcgacaaatgatgaactcccggctctttgccgcccgacccgcgtttgtgcgacccttctccactactcagattgcgcgaaatgcctcgtggagacgtccaaacgagctgaacgactacgagaagcaaatcagccagatgctgaccgacgagttcaaacccgtgagtctggatgtgcgggacatttccggcggctgcggctccatgtttgccatccagattgtgtccgacaagttcaagggcatccccatggtcaagcaacatcgtctggtaaacgctctgcttgctgacgagatcaagcagtggcacggtctgcagctcgtcaccaaggctgcttagaggaagcgatagggatatgtgcatcaacaaagagatgttagacaagagcctgtgagccttgagatgaggatatgtatatagtcaaggagacattggacgatatgagagttgctactgaaccacctgtggctagaagaggaggtaggggcagtaagtacatgccagtagtgttgttgtatggatatgtcgttaataaatgttctaccgggagtgtctgtatcttactacagaacagtgtgatacacagttctttgccaccttgatgacatgaatggccttttggaaagcatattaatgtaatgattgcacacaatatgtacagtttgtagcgttaccccctttttatttattccttgtcatatcccccagttcgtccttctcttaaatgatgtcgtcgtcactatcactatcttctgcctcctcgccgagctcctggaaactggcgtaactgagcatgatgaaggctccaatgatgataagacctccaatcacgcctccagttccaataggcgtgtcgaacagaagccagtcgacaatagccaccaggaagatggtcaacagggcagcgaccgatccgataacgggagaagtcagggccatgagaatcagaaaagcacctgagaagatggcgttggacgcaatgttggcaatcatgatgccggcagctgatccatggggcagctcaaacggctccaggccggtccagtgaaggatgggaagcagcagccacaggaacagcagagtacagagaccgatacaaaaggccaccacgttggcaaaggcagcctgacgacgtggggagatggtgttgggagggcaagccagcttcttgtacatgacttcatagagaccatagagaatggctcccactccgataatgaggtttccgatacctctgtgggggtaagagacctcgccttctccctcgttagtgtcccagtaagacacaatgagcacaccaataatagcgaccaccacactgaccaccttggcaggcttgagagactctcccagcatcggcacggaaaaggcataggcgaagaaggccgagcagttgtagatggcggtcaggtcactgggggtggtgaggtttacggcaatgtaccaggaggatccagcgaaagacagggccacaaacagccagaaagatgtgaccataatatacttgagcggatgttgaccggagaagtcacctgcgtgttcttgagtggctcgggcggtgttcaacacgagctcgtattgccgacgcagaaagactctccatggggtcttccatcgcttgaagatcttgatgaacagcagctgtaatggtaacagaaagacccacgacgaatgtgtcaggtacagcataaagatgggtttcttgtactgcaggttatgagccacgtagccggctgtctcggtctgagccacaaacgcgatcaaactgaccaccaacgagattccagcatatagataccgtttgtcgggtttggtctcggacttgaagctgtgagagggacgtcgatgttgagaggtctcacgtgtgtcatagtcgtggacgtggtcacgagagtcgcgtccaccttgctccagaaatccgtctcgttcgctcatttcgttctagcaagggacttataggcgaattatccaattatcggagaccgaagacgttgcacgtttcagcattcgacagatgctgcactgcacggaaaccctaacccgaagggtttaatgtcgtgtcaaacgcggcctggaaatctcctttttggagagattggtcacgtgtatgataaataattcccacgtgatgcggtgtatagcaatggtgtatcttttggcaggccctaggtcttatctggattggtcaaaggtgcggttaagcgaaaactttaaatcacgggttgtgctggagttttaacttctgggggaggacaacacaggttatgagtttgggaaggagacgaactacacgtggggacgtacagtaaccgagaaagtcctccctatgttggagtcctttaactttatactctcgtgcatattcatttcacgtgacttgaagaatcatgacattctcgactgtaggttacttgcttgtacttgtatgtccattgtagcttgggggctttggctcgatatacctgtgagtgcggtcacgtgacttgtcagggggtagaaataaatctgctgtacaagtacaagtacaattgccaccagtatagagtcttattcccgaacgagactgctccttggctcttaaaggttaggacggctatggagagcccatttaacctgtttaatgatgtcgacagaaggtcaacaaaggtcatttggcatatgttctcttagaggaatcggtgtttcagatggcagattatacatgggtggaggggttaaaaagcgctactggggacttttcctgaaggagggggcttatgactacttgtacttgtatcttgtacttgtatcttgtacttgtacttgcaccaccacgttgatttgcattcaagaaaatcagatgttacgagactgttcgtcacttggtccatgagtggactgtctatttgagagatgcttggagactgcaagtaccaaaaataaagcagtaagaaactattgaaatactgttttatacgattgaagtacttacggtacgaagacggtatgtacttgtgatagaccaagcttgctcaaacattcttcaacaaacattctttaataatgttaactaagatccttgatccaagtaaaccaaacaagacttcagtacagacttcagtacaatatatacaaacactgatatctgatattgtcgttaattatgaccacttctgaaaaccgcaactcttccatacgttacacgctcgacctacttgtagacgtgctcacaattaccggttcttgttattccactcactctcacagatggcaccaagcaaccccgactcaaccccgactcattctcagagaacgattcaacctgtctaataatgcaccgatctcaaatcagaaaactgcacccccctcatatcacacacgtgtcaatatttcgcgtccatgatatccatatcacgtgaccaacccacggtattgctaatagccaccagaaaacaaactactgtacagtatgcacatgagctcggtcctgatcctgatgctgggtccattaacattaaggtttgtgttaccctctcttggtgaaaaaaagctgcgtgtgcgatttgaatcaaagggtaaaattataggcccttcataccaccaccaccaccacgaaaaatgactgtggaggataacctcgatattgacttttccgatctggaggagaagtacgctgtcaacgcggacgagggctttgagtctttcatcgttgtcgatggagctcctgtgattccccaggccaagcaggcagccctggccaacgtcatgaagaagttctttggcgctgttggcaagatcaaggaagacggcatctttattcccttcgacgaggccaccggtaagtccaccggatttgtcttcattgagtacgagacgggcgagatggctgctgctgccgtcaagtctttccacaacaagcagtttgacaagaaccataagctgcttgtcaacaagctgtccgaggtggagaagtacggcatgcagtacgacactctgaaaaccgaggagtttgtcgagcccgagaccgagccttttgtggaacagggacatctgcgaagctggctcatggacccccagggccgagaccagtttgtgctccatcgaggagacacagtcggagtcttctggaacaaaaagggtgatactctggaggctgacgttgaccgagagcgatggaccgagacccaggtctactggtctcccaccggtacttaccttgtgtctactcatactcaaggtgttcagctgtggggtggccccgactgggctcctcctatctgcaaattccagcatcccaacgtcaagatggtgcagttttctccctgcgagaagttccttgtcacctggtctaacgttcctctcgttctccctgatgacgaggagaagcgaaagagcattccttttggccccgctgacgagggcaaacagatcattgtatggaacctcgagactcgacttcccgtccgaacctttgctatgcccccggagaagaagggcgcctctatgtcctggcccattctcaagttctctcctgacgacaagtacgctgcccgtatgatccccggagagcagctgtctatctacgagaccgagaccatgtctctgctggataagaagtccgtcaaggctcccggtatcgtcgactttgagtgggctcctgctcttgttaacctggagggacgacaaaagtccgccactgagtctgttctctgctactggactcctgaaattggcaaccagaccgctcgagtggtcctcatgaaggcttccaacaaggaggtgctgcgaacccgaaacctgttcaacgtggccgattgtaagatccactggcaggaccagggacgcttcctgtgcgtcaaggtcgaccgacacacaaagtccaagaagtctacctttaccaacctcgagttcttccgactgtgcgagcgaggagtgcccgtcgaggttatggagctcaaggacaccgtcaccaacatggcctgggagccccacggagaccgattcgtcaccatttccaactcggactccaccaccaactacgacggtcctctgcccgccaaccgacacactctgtccttctacgctcttgagcgacacaagggaacccagggcacatggaagctgatcaaggcatttgacaagaagaactgtaactctctgttctggtcccctaacggtcgattcctcatcactgtcatgattgagggctctaactctatcgatctcgacttctgggacatggactacgagggtgaccgaaagcacggtgacaaggatcttcctgccaacctgcacttcctcggctcgtccgagcactacggtatctctgctctcgagtgggatccctctggacggtttgtcgccacctggtcttcctactggagacaccacaccgaaaacggatacaagatctgggacttccgaggccagctgcagcgagaggagtccattgaccgattcaagcacttttcctggagaccccgaccccctactctgctctccaagcagcagaagaaggatatccgaaacaacctggaggagtactctcgaaagtttgaggagatcgacgccatggaggcttccgaggcttctcgagagcttatcatgctgcggaagcgactgctcgaggagtggaccgcctggagagcccagactgacaagaagctcgaggagctgggtcttgtcgagcccgagcctgccgagtccgagtacaccaccatcgaggagatcaaggaggttgttgtcgaagataaggaggaggtttgcgagtaatctattcgtgaactattaaaatcggtcgtcgtatgcgaccataagcaaagagtttaaaactacttacgattgtatgagagatgttgtagacagggtgtccattgtgtgccctagatatcgtattgtactggtgcaataccagtagtatcggtcaaggaaagttgcagtaagtaggtactgtacatactgtaacattagtagagaatatacatacgacaacttgtacagtacccagaatacttctcatatacaactcattgatacttgggtgccagtggtagtgtacaagtataggcagctggatcaacaaattgttgcttcagtgttgtatgagagattatatatagtcttcgcctgaatcctgcctctaccgcccgatgtttcacttctgcaacagtagcagccaaaaaaacgtatacttgggcagctagagagaacactcattcccatagtcttgctttgtcgatgttactccgccaacaaaatcagattggcttgaacatacgccttgcatattctctcaacattcgccctattgcttaccgttcaacatcagctctcatagctccggcactagttgtacagtagttccagcaagatcatctgcgatctaaacttttttcagtttttttttggaccagcatctcaccactatacaaacacatcatgggcaaacgaagcggatcaggagacgccaacaagcgcaacaaaaaggcgcggtacttgcccggagccatcaagaatgtggaaccccgctaccagggagtgtacgtaagttacacccgaggcaaggaaaacatggccaagaacgaggtgcgactgatgatgaacgagtggtgcgacaagctgtatggaacgactgtggtggaaaacgacgaggaaggcgacgacattgaagacgtggacgacattgataaggccatggctgccgaggtggctgccatgaaggataccaagaaggatctcatcactccattgcctctgggatgtgaatgcatgttatttgtgcgaaccagaaagcccgtggtgcccgtggactttgtcaaggccatctgccaaggagtcaaggacactggaaagaagtccactcggtttgttcagcgtatgactcccgtcactctgacttgcagtgctagcaagcccgagctggagaagctgtgtgatattgttctgggtccccactttcacctgaaggagggtcagaaaccgctcaagtacgccattcgaccgacgatgcgaaatttcgacggcatgaaccgagacgaggttatccagtcagtcgcttctcgagtgggccaggaccacggccattctgtcgacctcaagaactacgacaagctcattctcgtcgactgcttcaaggcctccattggaatgtctgttgttggcaacgttgaggagtacgagggacttgccagattcaatattgaacagctgtgggagcgacacaatgaggccgaaacaggcaccagtcgagtcaacaagaccgaccagacggtgaaggacatagaagatgaggccgagaaggccgtgttgaaggaggagattcaaaaagaggctgatgagaccgaagcaaaggctgagaaggctctcaaggagctggacgagctgaaaaagggaaacaaggatttggaggaggacaaaaataagacgagcatccaggtcgatgagctggaaaaggacgctgagaaaaaagtgctcgaaggtgaagttgatgaggtgattgacgaggccaaaaaggtgagagaagatgtccgggacttgagaaaggaagtgtctgagtagtttatatttagtatttatgatatctgtcaatgacagagtgactggagcgaagatgtatgcttctgacacttgaaagaaaccatatgctatgccatctgtaacaaacgacaagaacatctaaaatttacggtgtattgtatgtaatatacctacagtatatacagtacgagcactggactgtactggtagtgggtgtattattattgtttcatgcaatatattcattattcataaggtgtctatgtaaaaggttgacacatgcaaaagactgttagtagcgatggttgttgtttttggttttgagtgtggtcactctctattgagtgtcactaacaagggcttcagccagagattcaaaaacagaggaggtcagaacctgacgaatagaggcacgctcctcaggatccacggtcaaacacttctccagaagctcaacccagtcgtcgttgccgtcacccagcttgctcttaagaagctcccggtcccattgagcgttctgaatgagacctcgaagcttgggaacaaaagaatgggtgaaaggcaagttacctaccaggagggcgtagaccaccactccataggaccaaatgtcgacggaaggatggtaaatgggctcggctgtagaaagcagctcaggagcagcgtagggaagggagccaaggttgtctcgcttcaccgagcctccctgagaagagggagtggaaggcacaggagtagcagtaccattggcggtggtagtgccccctcttagagtagaagaataggtggagggaccaatgggtcggttctgtcgtcgagagttctcatgctcctcgtcctggttgatgtagtcagacatgccgaaatcgcacaccagcaggttgtacgaaccatcatcctgggggtccaagagacagttttcaagctttatgtctcgatggacaatgtgcatggactcatgtaggtacgacatggcacaagccagttggaaggcatattgtcgagcagtctccacatcaatgccctgtcggttattcttgaccaaatcaaacagtgttcctcccataatcttggaggtgaagcagtagatggctcggttgtcctcatagacatactccagatccagtacattagggtgtcgaagcgtgcgccaaatgttgacctcctgcagcatctgcaaatgttcctcggacgggacaattgcacttcggcttgtatcgttaatactgccaacagagttggagttgcgtctagagttgaaggcagaagagtcagcagactccatactggagaggtcagactcgctggttcgagcagccagccgggcgttcttcttcaccaccttgcacgccttgggtttgttgggctctcctccacgaagagacttgcagtcggcctcgtaaacgtccgagaaccctccgtatccaatcttctgtcccagagtgtatcgtccaatctcttcaccagtgagtgcgtcagcagtcagagaaaattctgcgttgccagatggggttccggccaccactccctcgggctgactgcccagggtagtcatgttgcccatgttcacggaggcagaccgagacactgagggcgaagagaacttggcgagaaagttctgagcaggcgaagaggctgcagaagaagcagagtcttgggtcgagttgagcagggtgttgtttcgagaccgtcgcttggaaaaggggatagcgggagggggacccacagagccgccgtaggagttctggccaaacgactgcggggagaacagtgagtttgcaatatggtcatccttatgcgaaatggacataggcgacgacactgtgttaaggggcgacatctgcatctcggcaatggcagatcgcagtttctttcgggtgctgaagggcaaagacttccagtctacagaagcagcggccgaagcagcgaggtcgacagaactggagcccgtgctgatatccctgaactctccggtatccgaacgtcgaggagaagccaccgaggctggtcccgacaggttggtggttgcatcgctcttggtgtcgccctgctgctgggtgaagtccatgccggggacgtattcgtcggactctccaaagggcacacgttctcggaacgtatagtcactatctctgtacgacttggagagtgtctgcgacagccttgagaagtgtcccttgcctgctcctcctccaagcacgtctacgggctgtggctgttcgtccgccttgaggttgttgaaagtgtttgccttggcgaatcgcgaggtgtactggcacggtttctgtggcgactgcgtttctgcgttcatgtctgtgtcgttgtcatcgtcggtctggggctctgctggtggcgagttgagctgcatgggcgagtcgcactcgaacccctttgctaccgtcatggcatcgtcggggttgcgggtgatgccagtggtgggtcctgattttccaggaaatagaaagtcttccatggcggtgtgggactttgtggatgtagcggtgtaacgatgtacggtcgtagttgtggttgaagtgtcgggtttactcttgtgtgtatcgattggtatcgtctgtgtattgtgtgtattgtgtgtattgtgtgtattgtgtgtatcaagagtaacttgcactaaggtggagcagatgaagaaagaaaacctccgtacttactgtagtgttttatttcatgtccgcagcagtagctttgtgtttcacaccacctcagcttagacttaacactaacataccatacgggcccaattcacagcctgcgcgcaccaccggatcattgtctggaaactctattgaagatgcaccgcaggtttggtgcaatatttattccggcgccataccctgggccgccgtgtgggccgccccagtcgcgttccacgccccgtcgctcgctaagaacccttacgttatcgtagctccatccatgcttaccccccttatgtcttcatttttcccctcatgctaaagtggtgactgaatctctatttccttaccttaatcccttaacaccctcgcacattggctttttttcccttgtctggagcgcatcattgggctgtctatctgatgcggggcgaccaatcatctggccgagtgtgcttacctcatcctcccaaacggccgagaacaaaaaggcttgagtggaaattcacaatcccaaactcaaaaagagaaaggaaacgagaaaaaaaaaattctcccaaattttatctgttcaagactgcagaagccgaggtggaaggaagcgacccgcatgtgagggcattcttaacggccccggagactggccgggtgtacgggggccgtgttccccgttccgccatccgtttcggggctgtttttccgcccacagcagcgcctatttttgcctttattttacccttcaatatcaccacgctcctctttctatctcgcatgtttagtgctgcccagcccgcaactgggtcatcaaactctttagagttgcccgacggagcttaaaaaacagcccaccgcaagtgactggaaataaccttgcgagggagctcatgtggcccggtcacgtgggactaaagaagtcacacacgtgtatggaggtctcagcgggaaaattagacaacaattgctccacgtatacatcaatacgatagctcgcataccctttccccacccgttttctgggcaccagtcatgtgatgcccaaaagctgcatggtggttcccctcctcttacaagagcttgagaaagagcttgagaaaccgcatgacgtcacttttcaacattcacccacgctacagcaattgtcggccgacttgggtacactatgtactgtacttgtagaatgctgtatgggacacgcgttagagtctccgtcttgaggggtactttagtccatgatgtcattgtctcaaagttcgatatgagtacagtataccgttcaagtggacaagtacaaggtggagagtaggacttgtatcgaacttgtgtgtactgtatcactcgtattcgcgatctcttgctgtctgcagaacttgcgctcggtacgccacaagtactcgctcgaacatgtgaaaacattcctttgaccacactggcgcgcttacagctgtattcgtaccatgcctggtcatgcctgcttattggcataggtaaacacggcccttgaatgggagcagagtctcacctcagagggttgttgaggggaagtgtctgggaatattattgctacaacggagcggggttttccacgagaatatattgtatatgtatatttgcggcttttcagacccttgaaaccattctctgacgcatctatcacttttttgagccccatgttgctgctgctcctccatttactgtcgacagagtttggcggcctgcgtcggaaaagaccgtttgaaactagacggctatagacgcgaggaaaaaaggaacttcgggtaaactcagacgtctgaggtgcggctggctaggcttcggaaatacgcgggaatacgtgaaacatttctgactccaagagagcagaagttgcaggcgatttggtgaggaaacagaagaatccagaagaattcagttcaaaacacgtcctgacgccaatatggttgccgctttagtcttgccactattatctacgctattttagttggtctctatgacgtaattagatcaaccaggtgctacacaaccaagtacaagtagcgagaatagtcccacaggaggaaagacctagtcttgtttccttgaaaacattctggtgacccagcaaccatagcgccattcacaaacaaacccctcgtaggtacgatactgtagaaggtggttcgacatgtcggtaactcggtccccggcatctgaagccagacgtgaaggacaaggaaggatcaagcttgaccttcttatataaagtgggccaatcgtgtcttggggtagagggctgcagattgtgtctcggatctccccggtctagtctcaccaagttgatcttgtgatccacaacggtggcaagagaccctcacgatatgtcactggttagtggtctccaggacggtattcgccatcagcagtacagaccaccaccatgcaagtttgtttcgagttttcattcactatggaacactttcttacagtcagctaaagtatttcgtctaaaaactccttcaccaatatacggagtgagaaagtgaatacatcgacagcacatatgtttaggtctcctggtatttaaaagctcccacgcgtgtcccttgacccatcccatcattaaccaccgctagtcaatgtttgtttgcttaaacagtctagcccaagcctgtggctacaactattgacggtccagatgattgactagaccaactcgagaaccgtgctgtctagcactatgaaaacctcattagtgctttaataatccaggtaggtactgtacccttggaggattgcaccacccatgtcgaaaatattctcctgtcaaggatatatgaagttacaacacgaaaactgggtagcgtctcgctttcacggtcgttattaatcatcactacatactattcaaacaatctatccttcctgctatgtagcgtagttcgtcctggtacttgtagctttgaattgcctgcgcttgagtcgctctcgtgtgccgttcacagactcactcccgccccaccaatccatccatgttaacgtatctattagctataataaagaagtgtcgatattcagtgcagactaaaagacactaatgtagttgttgattcggtccttttgattctgggcaatgcactctgcaatccaggtgatatttcgcacctcctgctctctggttttaatccaggcccagatggtggagtaagtaaactgctgtgtgaaggccatcttgcacatgtccatctcccgcttgtaaaagtggtcggccagcgacttgttgtccgtggtgtcaaacacacccttgtagtcagacagaccgtcgatgatggctcggacctgctccacgtcttcagctcgagacagagcctcggttccaacggggtacaactggccaaactggggcataagggacagtcgatcggaggaagacagaccagagccaaaggagttgagggcaatgttgatggatcgtcggtccgcctcaaaatcgagcagctgcttcataatctggtcagaggggcttggcaaggtcatgctgaagttgtaaaagtcctcgaggtaagccttgtacagccggtttcggatgatttcaatgttgagctcatccagctcatgcacgccaccctggaagcagtccttgaagtagggggccagaggagtgtcaacaagcacagtgtcgtagagagattccacatcagtggccacagacagagtgggcagggtgtcgaaccatcccagagggtggcatcgctccagcatctcggtgttgtctctctcgtgaagagctccattgatgagcagagcaacgttatcaatcatatatccataggaaatgtagtccatgaacttggtcatgggctccacgctctgagcacgcacatatcgaaactcggcaatcagcttggccgcggccttctcctggattgtcgatgtagagatgggtgagggcacattggacagaaagttgccgtactcggtggacgacagttgggtcttgaagtcctccagcgagtcacactgggtgaggttggtgtagttgctggacttgagcagaccagactggtagcctcgaacgagagcctcaacgtagccgctgggttagtaatggagcgcgcggaaacgactggccgtacgactgtacgtcaagagcgaacaataggggttggtgcgaccatgtcacttgctaaagtcgaaaatgaattaaataacgtggttcatctagacatccttcaagccattgattatcacattagatcttgtgatatcacccagatgtcgtgatgttctgttcacatatgccactgtgtagggggcggtgctatagcactcgtcgagcggccgtttttttcaaccaattcgtgcattccaccaataattggcctccccaattctccgcaagcctccaaaccctgacatactcacttgttgatgttgaaatacaagccctccattgctgtgtaatgtcgacgagttacatgtgcgattgtatgcaataagatctcggccgggtaaccaggggggagatttgtaggaagaggccaattttgggcaataagaatgatttttggataaatcaaactgtctgagcgggtataaaggatctatatggtttttttacctataaaataggcacatctccccattcatgaacgtgttgtggaccctagaaaccccagaaaataaactccgaccgacacgtactcaccaccatagtttggtgaacattgtcagaagagctacagaaacacctacaagtacagcatattcagagacgccaagtcttggcatactacacaaaatcgtggatttacacaattgcttcggctcctcggcatcatcgacactctgcccacatcactatcgacaatggatctgctattcgataccctgacacaagatctgctgccgtctgaagcagctgttatcaaaaacgacccgtctgccgtgacatacctcgagactctgcgccacttgtcagcaggagacgcaggagacgagttcgacaaggaagcccaatatctggaaacatcatacaacaacaatgtcaaaaccctggctactttggctgaaggaggacatcgacagttcttgagtgcagctaagaacctcagtggatttgagcaggaatacaagtcatttagtgctagctcgagcaaagcagctgagctgaaaatcgacgcggaaatccctgctcagggaaaccagagagatacgccagctcttctgctacgaaacattgacaaggtgagcgagattctcgaactgcctactctcacacgtgcctgcgtgactaatggactctattcagaagccctagatatcgtcggacatgccaagctgctgtcttctcgataccccaacatcaaaatcattcagaagttgctgcaggaggtgctctctgtgcagtctctgcttgtcaacgaactgctcgcccaactaaccaaaaccgtcaaactgccacaaatcatcaaaaccatttcatatctgaagcgcctacctcctttcagtgacctggcatctgcaacagagtcaaccagagcactgcatcaggtgttttttgcctcgcgcattgcctacatcaaaagccaattggctgatattccccataaggacgccagtgacaagtacctcaagcgatacatcgagattgtgagagaacacgcctttgcaaccatcacaaacttccgtctgacattcacggactctggtaacgagtctgctggcgaattcctccgatgcattgttctccagctgagtcagcagctcgatgagcacttacccaacctcaacgagacacaaaccgccaacatttggctgcagttggcatactgctctcagtcaatgggcagagtggggggagagtttggtcaggtgctcgtgggattggtaaaggacgagaacgcagagaaggaatggtctgcagcggttgaaaagcagaaggagatttctattagcattgcctaaagaacggggacaagcgtacctacaagaatacatttagcatatcatgtgtacgaagaggtggggaaagggctggtgtatgtgacccgtgcctattcgagtaatcagacagacttggaacttctacaccgtgttacaggacatactgcagagggtgagccagcagagtgctccggtaatgaggctggaagagcagctgacgagtggtatagaaaggaggtgtctggcacttcaaaccaatcacttcaagcattcagtcactaaaacgtaaatggacacttgtactgcaaattttccagatcatgcttcttgtggatattctattgtgtgaactgtgctcgactactaacacagcaaaaacgagtgcatgataactgaggcgattctgtagaagtgacccgttggttgtatcccggatactattcgcgcatctgtctatagtaaataattctacaaacaacagttcctcgtaggattcttactctcttcccaagcagggtactttgtagatggttggtcttgatcttccttcatctctgggctgctcattctcgccgtctccaacagcaacctcacataatacttgcaacatccattcatccgatttctcgtttaaacctccttcagtcgcgtcgactttccatctcttcattacagcccccctgggtggttatgccaagcctgtgggcacaagagaatggtgcgatgcattttggtacagtacactagagatttgggccagtctgaaggtggccattaagtcgatttgcacgtgctttcggtcgttttttgtagtcaaacttgctaggaacgttcatgttggtgtttgcaccacgcatcatcaaaatttaggaggtcattcacactccattcaccattagatgctgtctgttggtttccttttttttgcgctgttctcaaacagggtttctgctctaaactctcgccaaaccctaactaactctgccatcaacgagcagtagtgtcgagaatgctaaaaagattatttgtgtgccaaaaaacacattttattagttctagaatgtgtgtgcctcttttgcactaatttttatctctttaccctatatatagcccccacaggcttgcttcaaaacttcgctgcaacgtggattcccaaagtaggtttttgaatctgcatgtaccccgaacatcccccgatattcgagcgtctgtgataccgtaacaggctggcgtttctgcaaggctgctactttggaagcgtatcaatgcggggtacatacgcacagcctcgcaggtctcggcttttgtgccacaagggcaatttgcagccttgcaatttgttcctacctcgagggcttttgagtttgcttgggttcttcagtacatccatcttaagagtggtctattcagatatctatgaaaagtagagtaacgaagagttgatagtcatattcaccatatttttctggtcagattaatgtcttcagggtttttctagctccacttttcaccctgtggtatcactctaaagccgctaacaccgaacaatggttcagggcaaaaaacggcgtgatgacgaggggtaaatttcgttgtgtaatacggtcggcaattttacggcttcaaaaataccctgctcgttaagtcgactttagtcatatcaagtggctgagtcattatggctaaccaggagtaatggatgaacttgtggttgtattgcacgtgtatgaccactccatcacccagccttccatacagctggatacagaacctggggaaagcatgaatctattttggactcgaaaatcgaaaagtcgaacagttgccatattcacttgctgtacaaaagcgcctactgctcattgtcctgcagtctcaggaggatgcacgtgtagcggtatcgcctggatgttggtgactgaatagaatatataagacaggtgatatacgcaccatcaaacacacacatacacacacacaatcacatgtctcacactgttgatctcgaacacggatacagcctgaatcaccaggtgtcgcatcgatcaaagacccaggctattgacgaagaagctgttgcttcttccaacgcctccaacatccagggtctcactggtgatgagtgctctgacatcaagttggccaaggtcgagacctcaggcaccaatggcgagtacattcacattgccggggtcaagtatcacaaggacgattttatgagcgcatttggaggaactcttaaccctggttctgctcctattccttctcgacggtttgcaaacgccgctcccattgggcttttctccttctctattacatgtttcattctgggtatgtgtcttgttaacgctcgaggagtccatgcccccaatgtcatggttggatgtgctattttcggagggggtctagttgagtttgttgctggaatctgggaaattgttgcagagaatacctttgccgccaccgtcttcctttgtttctcgtgtttctggtggtcctggtctctgctgcatctgccgattggaatcgaaaagtactacgagacagccgacgagttttcgcaggccgtgggtctcttcctcatgggctggttcatctttgccattctcatgactctgtgtacggtaaaagctacagtagccttctttctgctcttctgttcccttgacctggcgatcatctttctcgcatcgggccactttctcaacaaccccaagctcgtccaggcaggaggcggtttctgcatttcaaccggtctcttgggttgttacaatggctttggaggtgtggccactcctcagtctaccttcacctggatcattccccgagcaatcatgatgccaggagctcacaagaaggattactaattgcatgtatataatataatcgtttgagaatttacaataataaaacactactagtacaagtacaagtacaacatatcatacttgcaaacatacattcagtcaacttggctcagaaaaacttacaagatgacttaagttgctcaacattttccaaccgtagaccagggaaacaaaacaatgacctcatcacttgaaactgtgactgtcaccctgcttttacacttacttgttgagcttgagcacgaattttcgccttgagctataccacttgccaatatgagctacaacacttgtaaatatactaggaatcaataattaaagcctttacttggatgctatgctccttggagaagcaattttcgaactcagcagatccattcttcgcatgagggttgtcgtatatacagtcgcatactgacatcttcagcaccataaatggacatggtattatggattggaaagttaagagagagaagatgaatcattagttgtaaatccagaatccatacaacgtgaaaaattacagtctgtcctctctctaatactccgcaacagtgtggtataacaatttttatattttaatgacccattacagctatgtacgtactgtacctacttgtagtaatcctgttattgacgcgctctaataaatcatatacatgataattgtttcggggtgcgtttcggtgagttctggtgagtttgaggctgccaaactcgctcttgtcatggtcacttggtagtcttttctattctagagaatggtttttttgtttttttgtttgtttgttttttttctcagctacttgagggctaaagacccgttatgcccacaaatcggattcagattgggttgttcggaccagcgagcgtatggcattcgtattcgcttgttcaggtaatatttctgactcatctcttcaccgaattttttccctttattctataattcattaaaaaattcattcttttttctcttgttttaaaaaattctaacaattcatcttttttttcctttttttttttttttattctaatgattcattacagctatatacctagtaagccgggttgttggcgttcaataaacgacttatgactaagcaggtgtttcctaacatagtcaacttttttttgctattcaacttccggtatcctggccgagcggtctaaggcgccaggttaaggctaataccttaacgaatttcctggtctcttcggaggcgtgagttcgaatctcacggatatcattttttgcacacctagcttttttgagggaggggattcctcgattggatcggtcctcacacgttctacacactgccctgactaacccagtgttctttcacaggtacatagcgccgagtctaataatactctttatcctttcaaatcatatattgttgtccgcctctggcctctggccatcagcttccgcctctactccgttcgctatctactcctgctgctccttcttatcggaggtctgttcaggcttcatggcggggaacagaagaacctccttgatagtgttggagttggtcaggaacatggtgagtcgatcaacaccacaaccccatccggcagtagggggcagaccgtactcaagggcggtgcagaaggtctcgtcaacaagctgagcctcatcgtcaccggcgtccttctgtcgagcctgctcctcgaatcgctgtcgctggtcaaagggatcgttcaactcggtgtaggcgttacagatctccttggtggccacaaagacctcgaatcgctcacagataccgggtcggtctcgagagtacttggccagaggagacatcatctcaggatggccgtacaggaaggtggggttgatacaggtgtcctccaggtagtcgccaatcagcttgtccagcattcgggcattggtaagaggaggagtgcagacaagaccgaccttcttgagctgctcctgcaggaactggttggtctcagcggtgtgcagctgatctccaggagggaacttgacacccagcttctcctcaagagtgccgataatgtcgagtcgcttccagggtcgagagaagtcaatggtgagagtctcgccctcggggccctggggctggtactcaattttgtatcctccggtgatctccttgaccatctcggagaagagcagctcggtggtctccatgaggtcgtagacgtcggcataggcctcgtagaactcacaggttgtgaactcggggttatgggtctgatcaatgccctcgtttcggaactgtcggccaatctcgtagactcgctccatacctccaaccacaagctgcttcaggtacagctcgggggcgattcgcatgtacatgtcgaggttgaggtcgttgtggtgggtgacgaaaggcttggcggtggctcctccggcaatgatgttcatcatgggggtctcgacctcaatgaagtccttgttgtccaggaactttcggatgtactggatgatcttggatcgcacaatgaatcgctctcgggtggagtcgttcatgatcagatcaaggtatcgctgtcggaatcgggtctcaacgtccttaaagccagactggtgggtaggcagcatatgcagagagggggtcagcagcacgagctccttgcaaaagacggaaagctcaccctcaccacccttcttgggctcggttcggccggggtaacctcggataccaatgacatctcctcgtcggatcagatcatggataccccagtcaccctcattgtcctggccctgggccatgatctgcacggtcttgccctcctggtggagaacgtagaatcgcagcttagagccagcagctcgcagggtgtgcactcggccagcaacagaaacctcctcgtccttcttgatctctcctcgagcaagacccttgtacttctccacaaactcgtccaccttggtagtgacgttgaacttgtgggggtaagggttgggagtcttggactgtcgcagagcatcaatctgtcgagatcggatctcaaagtactggttgggggtcagctcctcctcgttggggcccttctccttcttctcggtcttgggctgggcggcagccttctcggccttctttcgggccagatctcgaagcttctgtcgcttcttgagttcggacttggagacctgctcgccggtctcctcgtcgagataggtcttggccagagcctcggtagtttccttaatatcagacatggtgtggtggtggaaggagagaatcgatgaaacttttcaccaagtctaaatttcgagataacagacggtagggtaagtgggttgggaaacatttatatacagcgtgcacatcacagtgaaaagagtgtgactcattgaggttagggctggacacgatgactcgccatatactccgtgtctttggtctataggaggaatgttgaaatcccgatcgaatgaagttcaagtaggttgtatcgcctgtatatttgtgaagcgcttccttcaagtacaagtaaagatgttcctattgttggactcctttgtttttcctcccaattcaatactgtgagccgtgactattcaggttagagtacttgtatttctagttgggactttaagtagatgtgacgacaagaatggaacaacatagagagagctgttggagatgtctggtgtcattctgggggcgatacaacatgagaaggctgttttatggtgtcttttattggttctttattatttatttttgttgttaaatctcatttaacctgtttttggtacgttattgataccaatcttgaccatctgaccatccgagcgtacttgactttagttagagcgtaatagactttagttagagtgtacttgactttagttagttagttagagtaacagacttagttaatccagctttgcaacaatcatcacagacggagtattttagtcagcaagagtacaagagtacaggcattagcacagggtaatctgcgagaccaaattttgtcacctgacttcatggcttcagaccaagcgttggtttatccatggatttatgttgactgattgtatgcacgcgaaatttcaattaacaaactcaattcgcgttctccacacaacaccaagtcagatcagccaaccaagtacaccatgagtgatggaaccaaaagtctagttgacgaacagtttgtgcgggcgctcgcaaaggttcttcccaagctgcccggtgactttgtcttccaccactaccatactaagaagcgtcagtgcaagcggtctctcattttccaggacgatgttctcgatggctttgacgagggagatgatgcggaggaggcgaaggcagccgatgagtcagctgataagcctactgggtccactgaatccgatgaactcgagaagctacctgaagcaaagagagaatctgtttctgactctgggacaactgaggccaaggacaacgaacagaagcctgtgactggggtggaggaggatggagtggaggaggatggagtggaggaggatggagtgaagaaggtatccgaatcgggtttcaaaggagctggctctttggatggggacaagaccgcttctaagtatacagacgccgccgaatccaaaaccatcaaaactgtccccccagagatcttggaacgacgaaagaaacatactgtgatcacccacatgtttgtcttgtcgtacgaaaataccattctcttcgcgctcgaaatctacaccttttacgatcccacaggagtcactctgtttgtttcaaaggcagacaccactggccagtctcccctggttgacggcgagtctgtccgagtgtcgatgaaagacgtttccagagccatcatcgatgtgcttctcaagcatcatcccggccagcgggtccgtatctgtctttttgcccgacccgaaaagcaataccttttccctttctcggctgactaccccaaaaagcatttcctcagcggccctcagctcacaaagtggtggatagcctgtctggacggtctcctcgatgactttgagaaccccactgccactctgcgtatccccggcgcagaaaaccgaacaattcagagcttcctcgagggccttcctagatggaccatgggcgacatcttcaagtaccagaagcccgaggtcggagaagtgcctgaatctgacgccaaactcgccatctaccaactcccccggttccctgatgaccccaaatctcgattcctcgactttctcgcgtctgaaggacgaactacaacctgcagcattgaaatgttctgggaagagatccagggccgccaggagttcaatgccggaataatggtcggtctaatgggcgttgacggcgttgtgaagggcgaaacacagcctgaaaccgaacctgcatcttctctgtcgtacaaggagttcaaaaacgtgcgagaaatcatcaccgagtcggattacacaactaccgaactcgtcattgacgccaacagagaactaactgaggatggaccagcgcagagccgtgtgggcttcaagggacagctggaacgagctgctccagtagcgtcggagctcaagcgagcccccgtcgtcaacactctcgacatgaacctggttagaaagaagaagaagactaactaacagaataaatattacattcagagcagctatagttctaacgtcaaaatctccactaatggatcctgtcaaaaatataacgggccaaattcctaccttcactgccgtctccagcaacgttcatctcagcaaccttgccaagaaacagcatccgttgaagctccagtttccacttgttcatctcaatgtagtctcccaactctagagcttccgcctgacgaccagttatagcggagagaagccgcccggcgtgcttgcggttcttgtcttctaatgggaggtggccacgcttaaaatcaacaagagaaacaccaatatatgatatcgaggaccccagcccctgcaatgaaggagccctgacaaacgagcggtatcggtaagttgcggcaatgtggattccatgagggtcagcgtcgacacatatgaatagaggcagcatctcgtcaaaaagacgcacaaagtcttgggtcatgtgatcggggtatcctttgccagttatcaagagggtatctttgggtatgtaggcacacagggttgtgaaaaccgcctctttctcaacgatcaaaatacaatttacttgaggagccagttggatatcgctgatgtttgtggtgtagggtatcaatgttgtggtatgtgtaggtattgtcactggagctctgtagtcgtccttgtacgaaattgtcaacgctgaatcgcatgccgaataaatgagtcccttttgagctgccaccacattgagagagtcacgaggtacttgcaaaaaatcattagttattctagcaatgcagctatccacgactccctgggttttgaacagattcacggcgtcgtagtagatatctctttttgtggtgattttgtccttgtccaaacaactcttgatgatttgcaacagtctcaggtagattgagaaccggttgaccgagttaccacagagtgtggtcagaggtatccctttggaagcatgggtttcgaaaatggaggcagaggagatgtcttcgtgaaactgcttcttcagtcgcgagattgttttgttgatgatagcttttgtgtcgtcttggtccattgtggcgtgtgggtgatgtgaacaagtttggtggtgttggagacatggaggagtacgagttacttgagattatgtttagaaggacattaaaaaatgtctttaaccgatcaagataatcttgcaagaaaaagaaaccgtgtagctcaaaaaaaaaaaaaaaaaaaaaaaaaaaaaacttgtgaaacgcaccaatcacaaatatgaacgctcccgacccatttgtaccctccatcaactccacttggtgttgcccaagtttgatccgttggtcgtttgactcgttcttcacgatattgccaagtcaagtgacacaacttgtagtataacgcaactacagtatgtactgcacttcaagtatataagtatataagtacatactgtacatacagtacaggaacttttgaatggaactggaacggtcagttgtacaagtacaggacttatattgcaccaggtacttgtacaatataagtacaagtaaattgcaattgacgtccctcacgtcactctcacaattgtttcgtcttgtgggggctaatcggcacccccataaacagggaggttctatgatcgacagcgcagataaaaaacatacaaaaagtcaacccgaaaagtgaagtcggaactcaaaaaattggaggtgatcataacgtacaagtacaataccaagtacaagtacacgtacacatactccagaaagctgagggagtaaaaatcaattaaccgatggatatcccacttatatatttgacctcggctaatgtgcctctatacagcaacaatatgcatgtctaccatcggatccatcggatcgaaccattaaaagatttagactcaccccacattctgcagcccttctgaacattagcgcaggcttcccgtactcgaacttccacttgtacatacacgccatgctacacactatcaagggtcttcgacaagtgcggggagctcggggcttctccgtgagctcgagagcgcttcttcagctcaaaaatgtgaccaagacaggtcttgaaattgaactggaacccggatcgacccccgttcactactccaactttttcctcagagatgccgcctcctccacaaacgccattgatccctcgacttcgcagcggtacttttcttccggcgagctggccaaggacatccatcccaagaaaatccatgtgggcaagaaggagggccaagccgactctgccgtgtactccactcaggacaccaaaatatgccagcatgatacggacattgacggcctgaaaatcgagtggtccgacggcttccaggagtactacacggcacactttctcaagcagtatgcgtcgcccgaggcttctcgaaaacgacgacatttggcccagcctattgaactgtgggagagaaaggagattactgaggcgctggacaaaaaccaaatccagaccacgtggaaggaataccagaccaccgagggtatgcataaaatcgtcaaggctctgcacgactacggtctggcgttcgtgacgggtctacctgaccagaagacaacggtggttgatgctgaagacaaggatgtgggtactgtcacagcagaacccattctcgtggaagaggtcggaaagaagattggatacatcaaggaaaccttctatggccgatcatgggacacccgatctgtccccaaccccaaaaacgtggcctacacttcgcagtacttgcctctgcacatggacctgctctactacgagtctcctcctggcattcagctgctccacgtcatcaaaaaccaggctgtcggaggcgagtccatattcacagactcgtttgcatctgctaaatacgtctgggaaaagaatcctgccgcctacagagctctgtgtgagattcctttgacattccattacatcaacgacggccagcattaccacaacaccgtgcccatgattgtcgaacaccagcagacagacaagagcaagtggaccaaccccaaagccatcaactacgctcctcctttccagggcccctttgacgcagttgagctagttgagggaggtgagaagtgcgagctattcagagaaggtctcagactgtttgaagagcaccttaccagcgctgaaaatgagctgcgaacaaagatggaagagaactcctgtgtgcttttcctaaaccgtcgagttcttcattctcgaaccgagtttgatgcacagtctggcgtcagatggctcaagggaacttatctggacatcgatgccttctactccaaactgagagttctatcaaacgattcctaaaccgactcactacgctatagtctctcaaacgtatatatacactaaatattttctatgctaacggggtatggtcgtcttagatcacctcgccaataatcttggaagcctccttgtaagtcttgagcagagtctcgcacttttctcgctcctgggccaggttttcgtcctcaaacagaagggcatcaaacagagcctccttgtacaactcgctgaccagtcggttctgaacgctctccttactgaagttgaccagcagatgcatgaccgccttggggacctggtcctggatggactctcgcacaatgttgaagtacgacacaatcagtcgtcgtatcaactcagtctcgagcttctctcggtcggacagctgctcgccttcctcgagatccatgtcgtcaaatgcagaagccatggtgtccatggggtccgaaatgtgcttcttgtcgtggggacccttctgggagcctccggaggacgagaaaccattggggaactgacccttcacgccagcagcaccggggggaggcatgacagggttgccatcggcgtccttgccaaagaagtagttgaggaatgtgtccttgggctctccggaggcgttagtggcggtggaaggggttcggtgatgatgggcctctcgctggtggtccttaccaccctcggtagaaccaggtcgagaagacgtggagtcgtcgtcaggaccattctcgatggcctgaggggtatccttgccgttgggagggagcatatccatgtgctttcgtcgcatatccttctgccggctggcgttttctttttgcttcttctcctccaccacggtagccatagcgtcggcagcgccaatgaagttgggatggttggtgttgatgtatgctcgctggatagcgatcagagactccacgtacgaggcggtagggccaagtcgctcccgcagcaggtcggagacacactcaatgagcttggcctgaagtttaggaaaccgagagagctcgggagatccgcagttgtggcagatcttcatgagctcctcgtacacaagctcgacgcatcgctgggagggcggctccagcagcttgatctgaggcttcacaagcatatcaaaggcgagctccggaacaaagagcgagggtcggggaccggtggagtttcgaatggcggttcgaatgtcgttgatggacaggttggcggtggggcttatcgaagacagcgctgtaccaaacacatcattgtaaatgtagtagattcgagcgcctccgcacagctccttggtagagacggcggcggtaccctcgatggaggtgacgaacttggaggcaaacttggtcatgagctgcagaataagagtgcccttggactcgccagagttgaggtatgacactccgtagctggacagttcctgctcggtctggcccataagggtattgagcttggccttgatgtcgggcagcttctcccgaatgtggttcatgagagtctggttcagagacttggcgagaaactgggtaccgcacttatgggagatgtttctgtacacggggtggttctggaagaactccctctcggcctccagcgagtcggacaggggcttgttggcgtggatatcctgctgagatcgattgatcacaccaatgaagcccagcttgagagggtatacccggccagacaggatatccatggcgttagtaccctggtccattagatccagcttggtgagaataccaatggttcgcttgccgtggggatcgacctgtcgggcgagcttaagtgactcggagttgacaatgtccacgttggcaggggagacagccaagatgatggagttgggcttggcaatgtactcgcagatgaggtgacgggtctgtcgctcaatgtcggtgggctgatcgccaatagggatcttggtgagaccgggcagatcaaccagcgtcaggttgagcacgtggggtgagaagattttgaggttgatagggattcggttgatgcccttgttgtttccggcaattcgcaccgtctcattctcaatctcctttcgaatctcctcaaagtcgtagaactgtcgtccgggaatgtgcaaaaactctccccattcgaccgagttggacttgggggttcgagtgtgcacctcgccactggatccaggacggtccttctcttcagagggcaggttgacgagctgcagcacgagaggtcgtcgggtgacgatgccagtacctcggggcagaaagtctcgacccacaatgttttccagcaccgacgacttaccacacgactgggagccgaccaccacgacctggggcaagtcgagtgtgtcggagccaatggtgttgaacacgaggtcctgcagtttgttgaccagggggatcaggtcttctagggatgccgacatctgggttagtggtgtttctggatgtgtcgtggttcacatgtctaaacgtatccgacttgaagtatccaaaatctaacatggccatgtatccaactcagtgataagttgcgtgtagttgacggggatgacactcctgctgacgtgtcgagaatcacctcaaagccaccatcgggacaccaccagcatcaacatcattgcgccactgtgatgatccaccatgtgaagaagacggataacgaagccacagccagcaataggaggcccaaagtgcgcttccattggattcccggccattgggcgtgtgtgcgacctttggccaggcgcatccaagctcgttttactcaccttgatgtgtatcgatgatttctcagagaagacaaatatgcaaatgcaaatagcaacacaggcaaactgccaatttggctttggctttttttcgtaaccaccacacacagcagtcttcagaagtttaaaggtgccgatgggagggggatatctagtgtctagagcacgtgattcggggccgattggatctgcgaatactccagtcgattcatgagacgctttggaactcgactgtcgtctttttttgtctcagaaaccgctccaatccacccgaaaactgtgctttcctaaatcataaagatctgcattgaaacaatagctttctactgttgtcaaggcaaccctcgccaccaccttcttgtctatgtttggcttgggaaaatggggcattgagtgcgtataactggtatataaaggtcggtatgcccaccccgtgggagcaccatctccacagtgcgcgacctgttcttcatcgcagtgcaccccttgcaccgctctcattggttgattggcatcgccaccgaccggaattatgcgggctactgtaaacgcgtctctacaagtgccagaagtgcaggaacgggatacaggaatgagtgagtaccagtacttagcgggtcggttgtgccgttaccagagtaaatcgcgtgagcgagaaagttgatggtgttgaacagggacactgtgatacatgggcccttatcaaatataacctgattaaacaacgagacgtctccccaattccaccctgtcattaccctacccggccttgttggcgtgctagttaaccataatgtgggcactgttctagactgatggtgggatacatagcgagaatacaagcgtataagcgagtacaagcgagtaccgtacaagaaccatacagatatgtacagtagtcatactatacccacaactgaggcgtaaccgatgccaaacagtcatagtcatcggcctgttgatatatattattcgttttttctcgcgtatttaaaactgtctatccgcaagcaactctggtatctggcttatcaccggcagcctatcacgtcaatgagactgtatgacaggagtgtatggctcaatgagacagagttggttctcatggtacagagtaaatgacctgtttctgtatcgtgagtcttcttcgtcgcaatatcatcaccaaaatatctactgtattcatgtatagatcatctgccggtttacctttcaaggctgctcaacgccgtaccgtaccgtactggtagctactcgtactcgtacaatttcgtccatttttagttttgtcaaatttcatctctcgtcgtaaactcgacatatttgtcgatctcttcaaagagcgatccaaaaatctgcgtctacgcaaaccgcctccgtcggaccagttgcggctctgatttcctcgactccgattaatgtatacagcagtgggttagctctctctccatgggctcatggactccgagtgccggtagctactccacattaaagcggggtgcgtgtgggactcgcaggagctatgtggagtgaggggagagtcgataacggaggatgtaggaaagatggagagaagagagcagggtcaaaaccacaaccgcaacaagctgagtggattgcaatttcatccagtctgaaatatataaaaataaaataaaaaaaaagagaccataactcgctctagatactcattctatctccacgcttgaatcgtaaagttcaatttagactttgcggtagcgctcatgcggcgcgatatttcgcttcacgtattttcgcccaagagaatccgaaacaagtcatctagagatccgaataatagccggagacgtcgaatcagccgaaaactatgtgattacataatacaccattgcaacggaccgagcatgaccctttttcgagccaggacaccgatcaccaactctgcttccgttaacccaatgaggcaagtgtatgcgttgtgcgcatcggctatgaatggagtcgtggggtggccgagcttatttcttatctggcggctattagttcctcaagtctgattagtctacgtccgtctctatataaggcccgtggttggccctctcccaatcagcgactctaccaaatccagctaaccacacaatgggttacttttacgtcaaaaagactatcaaggccaaacaacaggagcgggaggaccgtatggcggccctgcccgagtacaacactcctctgacctccaaggagcgagacattctcaagcaggacgccgaacatgtcgtgaaccaggttcagagcggcgatctcaaggcccccgaggtgctcaaggcttacggaaagatggccttcaaggcccagcgacactgcaaccccgtcaccgagatcatgatcaaggacgccgaaaagtgggccgccaacacaaacacagagggatctctggccggcttccccatctctctcaaggatactgccggtgttaccggttacgattcttgcatgggatacactggcaagtgctttaagcccttcaccaaggacgcccccatcatccgactacttaaggactgtggtgccgtccccttcgtcaagaccaacgtcccctacaccctgctgtcgttcgagtcctacaacgacgtctggggccgaactgataacccccatgtgcccggtcactccgccggaggttccactggtggagaatccgccttgctggcttacggaggctctcgtctcggtatcggaaccgatgtcgccggatccgttcgactgccctcccatttctgtggtatctacaccgtcaaatgttccactggtcgatttcccaaggctggcaacaacaccaccatgcctggacaggaaggtatccctgctgtgtactcgcccatgacccgaactctggcagatctcaagttcttcctcaaggccattgttgaccagaagccctggaactacgactactcgtgtcaccccatgccctggaccgaggccaacctgcccaagaagctcaagtttggcgtgatgtacactgatggtattgtggacccctcccccgcctgtgctcgagctctcaagatgaccgttgacgccctggaggctgagggtcatgagaccgtcgagtgggtgccccccaactccctggactgcctgcgaatcgcctctcagcttcttgtttccgacgctggagccatctccacccgtgaccagatctggcctgagaagaacgatgtcggcgtcgccagaatgttctttgcctgcaacctcccccgatggatgaagaagatttgggcctggtaccttgagcacattaagggtgacaaggtgtgggccgctctggtgcgagacttcaacaagaagaccattaccgaacgatgggaccttgtctacgagcgggagggatacaagaacaagtacttcgagcagtggcaggagtctggaatcgatttcctcatcactgtccccaatgctacccctgcgttccctcacaacggtctctacgaatccatttcttcctgtggttataccttcatgttcaacctcctcgactactctgctggtgtccttcccgtgaccaaggttgaccgagagcaggacaagctgcccgccgtgttcaacctcaagaagctcaacgctgtcgctcgaggcgcctactctcagtacaatgctgagaagatgcatggtctccccgtcggagtgcaggtcattgctccccgactcaaggaagaggactgtattgccgccatggaggtggttgagggtgccctgaaggccaagggcattaactaccctctgttgaacgagtaatttttccgcatataaaactaatgaagagatgatctattgacacacggggttgggctgtagaagtaccagtgctgttcgcagtagtttctaggaaacaaacagtcaagaaacaatcaattataacttacaaagactagttggcatatctaaagaaacggttctgcttgtcagtaagatcctggcattggatcttttccagctgctcgggggtagcaaaacaaccctcttcgtctcgcttcttgttttctcggtagttgacccacatgagcactccgttgagacctatggcgacgaagaagagaaccaccattgacacctttgcaggcacataagagggagcgtccgaagctcggaatgtttggggaccaatgaggtttcccacgcagtatccaatgagaagaatagcattgacggtgaccttcttggtatgaccagcagtgttggaagccaccgaagacagaatacaaatgaatcccacagggtagatgatgagaatgtagagtccagccagacctgcagcctggttatctggaatgaatgctaggagacacatggccattactgagatggactgggcaatcatggacatgagaagtcgtttctgagtgtattgaaccagcaaaccaaacagaatgcagcccactagttcagtggctccctgtggactttgcatcagaagtccttttactggtcctagtcctaaagtctcagagaacaagatggtattgaagtttgtgatacctccgttggggatgttggaggtcaagcagaagaagaagtagagccaggttcgtatgtctgtgaaagcctcgatgaactggtcctttttgaactttttgttctcaaagccctgctgattggatctgattcggatcaacactagtttccgctcgctgggggtcagaaaccaggcctttgaagggtcatcagggatgtgaaacagaaccacaacacctgcaaagatagtgatgactcctgtaataataaagacgagtttccagccatgtatcggtagactgttgttgttagcaagtccataagccatgagggagcccacaatgataccgatcccgttagcccctagccagatggcggttcggagaaactgctcttctcttttgtaccattgagcagtaacaatgacgaaggctggagtcacggcagactcgagcatgcccagaatagttctgagggcgataaatccagcatagttgggcgtggcatggagacacagaactattccccagacaatgatgaaggtactgagggtcttgatgagagggaatcgttgaagaaggtagactgctgggaactcgaatgcgagatagccgaggtagaatgccgttcctgtccaggagtacatgtctcccttcatgcctaagtcttctcgaagccccataacggacgctgtggagttggtggacttgtccatgaactgaaccgcgtaaacaaacatcatgactggacataggtagaggtcggtctttcttagcaggcgtctatcggtctctgggtcaagttcgtaggggaccagatcatcgacttcagccacatggtgttcgtcgagctgtttctccagcgatgtggatggtgatgttttgttgttcattgatgtcagtcagcttcctctggtatcaccatctatctatataccccatggaatacgacgttgcgcttctgccaaggcaataaaacccgccatttccacgcaactagttgtctcaaacagacaaatgcgcgtcttggcctgctaatgagaaggccaaggtttgtagataaggctagaaacgcgatatggaagacactaagtccggcttgtactgctttttaggagaaacagagtggggtggggtgcacccgccttccaagatgtagcattccacgcgggttgatgaggaaaaaatgggtagatagtgtcgatgttattgctcaatgagcgacaaaaaagccaattagacacgaatggaaattatcaactgtcatttaaattgatctcgttcctgtggtggacaccaatgacagcagcctgacatatcttgaatacaatattaattaattaacgaagataagctgtctgctaatctggattaaaccgacgcggctgagcgagcctaacgaatctcactttgatcgccatagcaagctggtgccgataccgctcttcatagagcgcatttattatccaagaatcgccgccaagcatgcatgccaagacccgctcctgtcagctgttatcatcgtcggggctgcgtttccgggtccaacaaagaatatgggacacccccacaaatccgacgctactgctgaagtggagatgcatcttggagcagatccaacctggccaccgtattggtatacaaaagatctcgtgaaccacgcacgacaaatactacaagtagccagaaactatagacaaacagacctacatacaagcagagccacaataaacgaaactggctctttatctaactacaagatctaaaattccaactccatcttcagtgtccacatagatctatcaaacaggacgtttatctaggaccatcgcattgcctgtggtatggtaacagcgattgatctagagcagtaatgctagctggcgaatgttaacctgaatgggtttactgtcttgggctctttggcgatcagacagggggtccctccttggatctgtccttggctcaggcagtagggctaaataccctgattaatatatgtttttgagacgaacgcaccattgtctagtagtaactcgtacggatgtgaataatggaaatgtaatcattgtgcatgagtcaaacggactgtgtcctcgctgtaaaaactgcttatcagctccatttctcagcagactacaaacggctcattccgttttcaacatgacccaaatagaactggtcggcgtctgaggaagaaagagggacagacacatgtttattcatgcctttttggagtcgttatggttctctctcagggcatgggaagataaaagaccagcgttcctagagcagacctgcccggaaggtggatggacacgaaacagaggctgagtacttaatgagctcgaaaaggggacaataatatcattacatctcccgttgcctccagcattttcgatatatgggtgataaacgacccatttagtctgctcttaactcaccatacagcactgtcaaacttacctgccattaatcatggaatctacccccccgggtgagctcttcaccacaattcttcaaatcttcttcttcaaaaacacaaagtcgtatcctgagatcattggtattgtgcagtatacattcatacagtcgtcttcgttgacatcatcatgcagtgccaatcccccaattcctggaactcaaggaggtgccaaagttgcaaaggagaatatgttacaattcttgaagaagtgaagaaatccaaataatatcatccctaagttttggatgcctttagggcccgcttctgtctctttccgtctctcgcgtagcccagcttttcttgtcacatctctccgtgcgtcatcagccacattctataacctgaacttacagcgtgcttcttttaccattcttcattgacttcacaatgacggactcgagtattcgattttgacgttaacacaaccatctaccaacgcctctctatcgcaccaaccaacgtctttccagtctcgtgcgttctgtggttccaaattctcgtccgtcagttctgaacgtgacagtcgtagaaacaattatcaccgctagaaaacaatcgagagaattcaaaatggttttaaacctcgtccaactgacaacacttttcgcagaagtgcagtccccttttgtactcgccgtggactctccttcttccccctacacatgtttggtctttctggcaccaaattcataactctggtgctggatgtgtccgccggcccactaataacagatattttcatgtttaacgacctctccaacttttctgaggtctccccaaccctctcggaacggtcctgactcttctcttctcctcatttctcctcaactaaacatgttcaaaccggacacccgtatctcaatgggcagtcaaaaacatgaaagccaaactagccgtggcgttgattctcagttaccatgctactttgcgtccattttcaatactcgttggtgcgtcattgcttagctctgtctgctgatagcaacttggttggcttgcacaggcaagttctttggctaaattcgactcaaaaggaaaaaaagatccaggaaaatgaagactattggcattttatgtggaacgacgacagatcttacggatatttcaaagtgaatgtttctgaacaagtgccgtttgtgttatggacccaccttgtgatgcaatatctgtgtacgtgatctactgtattttcaagccaagcttgtcactcacggtttcttgaatctcacagttgctatcttgctcattctcacgtcggtgcagtggaatcttgaatctaagtgtctcatgggtctctcaagcgatgaatttcgtcaacagcagaaacagacaacatagggactctcttggagacctaaacggactttgttgctgaagagtgggcttgtcagctcggcgtctcagcagatcatatgtggcatgcatcttgcatcatttccagaatgactcagactaaacagtcctttcccccgaggagaaaacaggggcattatttgatgtgttcctggccggggacgttacagttcatgacgatgtgcgtccctcatgcagccgaacgcaaaaggtgcatggatacgaaacaaagaagtgccgaatgagttcgaaaggacggcgaaaaaaccatgtgaagagccaatgtgtcaaaatgtatttctgaaaagcaatataccaactacctgtcaatgggttgtgtgtgtcttgttttttttttcttgttttttatattttttttttaattctcttttatgaagtgtatatgtgtaacactcgctctggagagttagtcatccgacagggtaactctaatctcccaacaccttattaactctgcgtaactgtaactcttcttgccacgtcgatcttactcaattttcctgctcatcatctgctggattgttgtctatcgtctggctctaatacatttattgtttattgcccaaacaactttcattgcacgtaagtgaattgttttataacagcgttcgccaattgctgcgccatcgtcgtccggctgtcctaccgttaggggtagtgtgtctcacactaccgaggttactagagttgggaaagcgatactgcctcggacacaccacctgggtcttacgactgcagagagaatcggcgttacctctctcacaaagcccttcagtaccgccgcctgtcgggaatcgcgttcaggtggaacaggaccacctcccttgcacttcttggtatatcagtataggctgatgtattcatagtggggtttttcataataaatttactaacggcaggcaacattcactcggcttaaacgcaaaacggaccgtcttgatatcttctgacgcattgaccaccgagaaatagtgttagttaccgggtgagttattgttcttctacacaggcgacgcccatcgtctagagttgatgtactaactcagatttcactacctaccctatccctggtacgcacaaagcactttattttctcacatatgttattttcagtcaggccttcctgtatatccgacaagctgaaatatcttgtgagccttctataagaacatagtagaaagtggaacatcagaaaagctgctgtaactgggtgtccactcccctggaaactccagggtggctgaaaacagggaaattccgattcgcaggctttctcaaagtcgtcatacatttgggctgcagtccggcatcataaaatgagggttggagacgagtagcaaaaagagttggtggagatccaaaaggatcaaaacaattgcagcacccaggattctcgtatggtctcccactacaatactaactgggctctctggtgcttgactatggctgatcggacgggaagccgtattttcaccaggatatggccgcaactgacaaatcggctaaattgaagacttggaagctccaactaggtcacaagtgccgaaaaaaatccggattttatgtatacattggagagaacacttcaccacgctactggtaggtctgactagatcgcaatacggacattcaaactcatcatctgacaagtacaatgcaagaaaacagaagttgtagtacttgtatggtccagcgctactaagtatctttgtagatccagctcatggcatctgccgaatcttgattgatatggtaaaagcacccattgttgttagcatccaatatctggtgggccttcttgacgccagtcaattatgctcgctggttggtttgaataagcccttcaagatgtgcatggagtgtgtcgggcacacagagtccatgaaacagagcgaatccagcgactgcgttagagcggcttttttgagagctttttccgtcagtcagtgtatatctgatagacgatattccgttcgagtctccgaagctgaggtcgttttgcgtcatcagtaacttcgcagtttgtagtcactggttcagataggtgctgagtaactgatgtcttgcaatactgaaaacggtagctgccgagatatctgttcatctccaccaatgataagtacttgattctagcaaattccgtcggtacagtatgtacacacgtattttactcagacccgccagcactcatccctgtctgtttctatccactcacgactgggtaattcggtggtaaagtgttgtttaggagcaagcaagtaaagatgtgaacatacatctccaagactcaacaactgttatatcaggcatttcaagtgattaaaaggagtcgccatgcgttgttacagacgcctctttcatttcaactcacggtagttcccaatttgggggaaaatgtgctgcgacaaaaggggggtacttgtataccatgctaagactatcgtacagtattacgatacacaagtctcacgatacatatacatatacgtagatctatcattacctgtattatgcaaatgaaatataacaatcgccctaactcctcagacccaacagcagctcgacatcctcggtagttcgaggaaagaattgtcggtagtcgctctcaaccttgtacgtgtccttgaccttgccctccagcttagagaactcctctacaaacttcttggtcgagtttcgagcaatgttgtccacaataacaggtgaggagatgcggaacagcatggaatgcaaatcagtgagcgccgacggcaggaagtcatccagctggaacgaaatctctgacaggtgagcaggctcaaggtcctcaccaagtccaacctgcttgacaaacttgtggaacagtctttcagttaacacctgctcaatctcatccacagaagactggaacgagtccaccttgtattcggaagcagaatatagtttaagagtgatgatgatctggtccaaacagttgagcagaaagatttcagcatcaaaatcagctccatcagaggcaactcgacgacaaaactccatgtagggatcgagggaattgtcaatgtgttttcgaacaacctgctcgtccaaagaatactgctggttggcctccagaatctccttgagatcaacaagcgtctgggtgaggaactccggcggttgcaaatcactagaaagggttgtgggaagagacacagaaacgtttcgaacacgcgactcgcaggttttggtgaagtgggtgttgcagaacgccgtcagttgggttagtgtatctaccagctgcgagtttggcagatgcttggatagcattgacttgtagaactccacgagaccagcaatcttgaatatttgcggtcctcgtgtttgtgatgcgactgctctctccactctgagtcgcaggggtgaacacagactctgggtgcagttatccacgagctcagaatcgttctgtccaatcagaatagatgtgttttcagtctccagaacgacacaagaataaacccaagcgagaatatctccaatgtatctctggcagtcgtaggcgtaaaagtcgagggcctttgttccgttcttctgtgagttctctgtaagtgccgaggtgaaagatttgagtagttgtcgtcgtctagtctctgtaaactggcccagggtctttgctcggttgacgtcattgagcaaagacagtcgttcccttagctgagggtcttgcttgaagttgtctgtctctcccaactgtgcgtaattaatgagagacgtttcggtgtctcgaatcaacgtgttatttgcgttttcaagagcctggttggccttgtacattgtgatttggccggcccgcgtgtcgtcgttggctagcaggatctccgagtccttgtggatcttctgggccttgatgaacacctgtttgaacgtctcaaagggaacctcatcgttgcccttcaaaatatccatctcgcgttccgtcagaacaaatgcatcagtgtatcttttgagcaagtctcgcttcttggaaatgttctcctgctgtgccatgagttccgatccctccgagaccacatgtcgagtgtcattcttacatgtgttcaccagctgctgcatgagcgtaaacttgtggttcaggtcagcaatggtgttgccactggcctggatctgtgctacgagcggcgcaaacttcttgagggcttctccattggctttgatcacctcagcttcagtgttggcacgcaaagatcgtcgaattgaggcggtgttgtcggtaatacggtcgtcgagagcaaccagcgcgtcacgtgttccgccatccgtgtaacttgtcgacaacagccgactgattttattttgaagcaccgtcgtttccatggctgtgtgggctgtcgtatctgtggtgatgatgacagatcatgttggaggctaatttgggaggttggaattagagttggtcatttcctagagaggggtgttttgggagtgaacaaaaggtgtactaccctacgttactcagttagttggagattatcgatcaaagacaccctgtattcgaagtactgcaatgcggctctgcaacaaagagtcgaggacaagaattgagtgaatttatacttgtactgcaggtgacaatgttcttgttcaatttgaaatacaatcgatacagatatgtccatactgcactggtagaatcacatgaactgcactgctagaatcgcgtaaagaaaagaacttgtggttcaattgacaagcctcaataccctcatctgcaatctccaaagttgactgttgtgtctctactcaaaactgttcgcctcagattcgcaccaaccaaaagtcgaaggcggggagcagagctgaagaattcagttggaggacgccttgcggggttccatagcgaacagagacaagcttctcaattgattcagagcctctgtagctgcagtgacaccatacgcaccacttcaaatatgccccacgtgctgatctaaatgataactccaagacactttgaatcctcattattactgtgagacattgtcatcatgaccaaactcggcggctttagctatctatatccaactccctcttgattcagaaacactaggaatccctcaggtgattcttccacagccaagaagttgctctcattgctctcaaagtccctgcaatccacacataaccgactcatgtgtgctgtctggctgcttcattgtatgttcaagctcgtaatcctgattcacctccatactcggagaatacaacaggtccagtgacaatacaaacatacagacttgtcgagtcacctccgttataactgcaaaaaaaaagtactcagatagccctttgatacactcaaacagctactctactgtacaaatcagctaagccaaccgtgcatctcaatgtggcgtattttggcttctctcgcctacacctgcagcttcaacaacatcgtatcatctgcacctttgagagagccacaaactacaccaaaaaatagcacccgtctgtcgcaatatcagctctgaggtcctggcttacacaatgagtatagtccaccgactctggaacccctgctaactcgaccccaccgaaagtcgaacacactacactagcatatctccgactttctcggaacccactttcctgattgggacttgataagagccgtgcattgctgcttatacggtcaacagaaggcttccaatagagccaataggagcggtattcaagtgctttaaactagaataaatttggaacgactcattctatccataaacacttttccacccgagtcccaaaactccccacggtctacaaatgcctgctctggtgctctggtagcccaaaccggagtccgagaaccttatccagaaccttatcccccagatctacttatatctagtgcgaaagccagtatcgaatccaccactcgacaaaacacgatggaaaaacaacaattgaacgagattgattttgttgcggaccagcagcaacagtacgttgctcccgcaacccgatcgtggaagaaaatcggcttcttggtcgtttctgccctcacggtgggcactctggtttgcaagtctggagtctcgaccaagtgtatgaaccacatgtatggcagtgcgcattctgcgactggcgattctctttgtccctcgcaggccaagcttgttcccgagggattcaccaacctggatttcattctcaaggatgagaagtaccacgacaaggctctgaaaaccttccagggtgccattcagatccctaccgaaagctacgacgacatgggacctgtgggcgaggagccccggttcgacattttcaagaacttttcttcctacctggaaaaatccttccccaaggtgcactctgagctcgaggttgagcatgtcaacacctatggcctcgtctacacttggaagggatctaacaaggatctcaagcctcaattgctcatggctcatcaggatgttgttcctgtgaacagcgacactgaggagaaatggactcatcccccattttctggctactttgatggcaagtacatctggggacgaggcactgttgacaccaagaacactgttgttggctctctggctgcagttgagctgctgctgaaggagggttacactcccgagcgaactcacattcttggctttggctttgacgaggagatatcgggtccccagggcgccaagttcatctctgagcatctctacaacaagtacggtgagaaatctctgtttgccatccttgatgagggttctggaattctagagaccgagaatttcgccatgattgttgctgctaccggcgagaagggctatctggacgtttccatctctgttaacgtagccggtggacactcttctatgccccccaagcatactggtattggacttgctgctctgatcgtggcggagattgagaagaccccttataagcctctgttgacccagcagaaccccttcttctacactcttcagtgtgttgctgaccatgatcccagtctcagtgacgccctcaagactcttattcgaaagtctggcaacgaccttattgccaacaagaagctcgtgagcattctcagcggcaatcccaagtacagagatctcattcgaaccacccaggcggtagatatcatcaacggaggagtcaagagcaatgctctgcccgagaccaccacttttgttgtcaaccagcgaatcgagattgagtctgacgtgtctactgcccaggacaagattgtccagaacgtgctaaccattgccaaggagcacgatctgtctgtttctgcctttggtgacttcatcattgagggcaagtccggagaagttgttgttgagctctttggcttgcctctcgaagtcgcccctcaggcccccgtctctggacccacttgggatctcattgttggaactgccctgcacgttttcaaggacactgtttaccccgaagactttaacctctttgctgctcccggaatcatgaccggaaacaccgacactcgacattactgggctctgaccgacgccatttaccggttcaaccccgtccgagagtctgccgctttcggcatccacactgtgaacgagcacctcgagttccagagccacctggagaccattgcctactactacgagtttgtcaagaacggcgagcacttcagcaagaagcaggagtaatgcagtgatagggaacctgcttgaataccctacaccatgtggcgtatctgcactccactcgtacctatatgtaaatgaatgatgtttaaatgaagcgagaatcggtgcagcaccagataagttatcgtcatcaggagagaaaaaagactggtgactatcctcgcggttatctaccccaccgtttgtttgttgtctatctagttgatgtgataaggtgaagataagagatgataagagatagggtttcggttgtggaagggatgtgtggactagatgtgaactagttaaaggacccacagagctttatccaccctggggaggtagatactctcaattttcaattcaagctggtcgacataaagatagtcaaactctcggtgccgttattctctttgtgtcagacaattcccttcccgtcccgttcctgacagctgcttaataatggcttgacgtcccgataagctggctatctacaggcacgaggagtcgtttggggtggaactcagtggcttgattagcttgtttaggaacactgataagcttggctgcttcggactgatggacgtggaatgaggagagactttggtccgattggcgtcgagatcgtcggtttaaagatgctaagggttaatagtaagacgcgagatatggtatggatcgtgtgacaatttcatagatgtgaatacagaatctggcgacgaccccatgtgttttctttttatatcttgcaaaacatcagattgttctatttgtcaaacctctctggacttctgtggcttcgtgccgtgagctgccagggcgtctgtacagtatttgagtcacacggttttgtgttaacggctaccggtcagcgtttagttgggtcccactgataagccttgggggatgttagtggcatgctttcactcctgcctgctcttgtttcggttgtccctggctgccctctagtgccccggtatccatatccgtcgtagtctcttttttcctatcggactgccgaaaacagaacccaccttgctgtctcacagataagcccaaagcttttgatgctcgatgtgatgactcgcacagctgatggtcggagcgagaaaatgctcaactgccgtttgctctactgccgtccgcagttgtctcagtcaggttgcccgtgcgatctaacatccgcgatgctttacttgccagtttcggaacaccttggaaatgtcttcaaaccaaagacaccaacagaaagagataaaatcagtgtggagcatacccaacagtggcttgattcgacctcccagtattattatggcagccacatggtccataatctgtttcacgtacgtgactcgcacaactcaccacagtggagaagataagatgtgacagaactctacaattacagcgtgaatgcgtagaagaatgttcagtagtgctagaaataatccgcgtggaagtctttgaaagactatgtctaaacttcctactacagtttcaacatgtactgatctctcagacctggcacctccggcaaaagtgcttgtggtctttgagacgaattgtgtagcctccggtggagaccattgagacaaccagaggctgagcaagcacacctcccgaagtggagctccacagaactgacgctcaagcttgcttccaatcgcaaagtctgcgccgataacacatggataaggcgactcgtacatgtgtgatgcacgctattgcactgccccggacaatgggagagaatcgaaaccacgtaagacacaaaaagcaaggattatgacaccatgtaaactgttctatactggaagcagtaaatatagaaatttgccacctgatagacttccgagactcagagttcaatatctgtgagacaaggctgtgaaggttatcggaagctgaaggtgtggttatgagtggtgcacaagggtgttgaggcgtacgaacagcacgtttgacaccacttttcctgtaacctgttggggcaagtcaattcatcagtatcgtgctttgttacaatgtgatttctctggcgattggttcagtttgaaaccatgtaacacgtggtttgttcagcctctcttcttgtgaaacaattactgtagtttgaaggtagcttgaaggcagtacactttgagtgtttgtatttctgataccagctgtgtaggtgtaggcttgaaaacctctccgaactagacagtacctcgtataatccactaagagacccacttcttaagccagcttcctgaaacattctgaatactgctaacatgggctgtagcgcaataggaatgctcaatatgaaagagaagatggctgctgggttggtaaataggagccattgaggccatatatctacacacacagacttcttatacgcttgagagcagactcacaatacgacgaatatttttgacattgacccttgatggagggatcgacaattcaactcttgtagtaactgaaataaagccaaggcatcgctgtagacaagtccatttcttaaagtgaagtatgataacacccacagcagtttggctttgaatacgactcgagacaactgggctgtagttgttggtcatggtaaggaagtgaagagtttgaagcggcggaaaaagacttgtggcatccctgaagaccattgctactcagtcaactccttcacgtgattgatctcgcagacggatacccctctcagtcccaagagtcactaagtttagtacattttgcactctactctagagcagctctaagaaatgcatctaagatagtgtggcgctagtcgcggcctagagaaaccagatacatgtgtttgatggtgtcggacaccgttggtagacaaaagccgcccaaagtgtcaattggtgagaaagacccataacttttcgtacagaggcgataagaaaaaaaggagtatcttaaacgaaagagcttgccaagaggacttgtttgataccagagacaccaactttttatgtcggctgtggggccaataaacagttattaattcgattaatgcgacagatgtacccggtcctacaacgtcagctgcccttcagattgcgcgagggtcacaacaatgtttcaaagacacttctgtggaggaatcatctgcgcatagtaaggatgactctttcttgccgatcgacgtcatccaggagttacaggacttgtcggtacagttccttctcgtcataaaggggacagcaagagataaccacgtccaaacggctccttcttctctccctctaccatggattccaagcttctcgtatcgccgcatctctatttggggaatgcccgtctggctgctatccaaaccaatagaaacacagacaatatgtggatttacctcggacattgacgatatcttccgagtctattgatcgacagaaatacgagtttcaactcgtcggcgacatcacatgaaaaacaccacatcgaactcaatacttatcgtccgaagatgagctcaaaagtactccatgtttttctcggaatctccctgttctcagagcctgtaaattcccccgagcatttcgatatcaccccatagcacacatcgtccacggctcaaactcagttgccccggtcacttgcattagcgccgtttacagcgggcatatgcggtcctcgatgtatggaaaggctgatttttttttttttttttttcaagccggggcagagcgtgcttaagacgtgctttggggacggaaacagtggaaggagagcgcaatggtatccaaccatctctgtaacaacaaacctgtctattttgcagtgaaaaccaccagaaggacccctctcaggctcctatcagtgctgcgtcgtgtgccgccaaaatccaactctatcgagtttggcacgggtttgcaaaaagcggatagacaatgtgggagtttaattctgtttgtaggaaggggttcccatgattccaacatcctgctggtcacgtggatgcatggaatgctggttatatagccgctgagagcgagagtcgaccggggatgttcttgtccatcaaggactcgaatccaaggcgacaaaagggaacaagtttagttggagtaaaagtggcacaattacactttcataacaactcccaactagagtctaaatattcacgtatgacatatgagtaaaccaacacggctcataccgatgcgatacaacaatgagacataatgatggggtcggctcataaaaccactgaattctgacacctttcaaattttgtcggaaacctcttcccgtccgtccaagtttgcattgtgtatgcatcttcgtgcacggcattatgtgcggcatctctgcacggcaatgtggggttagcgatttcgctgcggacacgggcggaaaaaaaaaaaaaaaaaggtgcaaaaaacgacgggcaaaacacaggcctggaacaagggagaaggagaaatggcaccaagtttttttttacggaatctcgagactgcgtatacccgtgttacaatcaaaataagactctatattatttacagtatttcacagataaacatacccgtggcttggttgtctttttggcacttgtgtggcactattttcccatagataacgcctggaattaggttggcggccaaggtcaccgtagcggatgtagttccgatgtgaccggaaaaaaagcaggccagttggtttgggaatgtttttgcgagtccaacgacatgtcttgggaatctctggggcaaatatccgcttagtttgagctatggtgaaaacggccaattaagtacctactggagacccaatggtgtagagttagtgtggtcgaacaagtccgatagtgggttttcgaagcgtggaacctgtaataagtggggtaaatgtccgggaagttggatctggtcgtctgctcgtgggtgtagtgcgtattcctgtttttgcaaacgacatttgcgctttccccacaccatctctttgatatccagttcatgtggcttatcaaggatggtcattgcgttacctaactacgaggcacacaaggttcaaaggttgtgtgttgataacgagacaaagacaagagtgtgaaattaggttcgaacaatgttccagtcatgtgcaaggagtagtaatggggcggggatggtgtattttttgtggggggttcgagatttgaagtcacggaggggccaagatggccgagacgcagcaatttggacggtaattgggtctctgtcgtccacggcacgaccccggcccactctatcacctccctccaactctacaagtgtggctccggcaaccaaaattttcgacacatttagactcccgttggacttccttctgtttacttttgtgttaatttgtaggtttgcacagctagcaccctttatcgaggagttgagggttggaggacaaggaccagactgtcgtgtgaggagatagccgttgtcgggcatatttggagacgttgggggcggaatttcgagacaaaaagtagacagatacacttgccaagggtatggctatgagccaatgtgctgcttaccgcaatcgaagcaggtttcgtcgccaactggcccacccatctacccctcttatctcctcggcacaaggtttcgaattaaagtggccaaaactctagttaggcttcatagttcaggtgcatgcggccgagagtcttctgtggcccctgatgtatgacgccttatcagtgcgcagaaggcctcttgatagtatatatgagttcctccatgtcccagttgcgaggctttgcaattagcgctactcgataagtgtgaatacacacccacccacactcgcacacttgcacccgcactcgcattcgcattcgcactcgcaccccagcctgacgcaagcgcagtaatctcccacaccatatttcaaccaagcaagagtgcgctcttgtcctgctccatattccggcttcattgctcggtctttattcttggcccactgaccaaccaacgcgatccaaactgttatcttcccctcattgaagaaggcccttccaggcacatcgaccgacatagcgagcacctcattgtacgccacgccaaagtttatttatccacacggtgagtcacgagacgaggggaggtgggcatgaccagcggcaatattttttgacagaggagaagaaacaaaaatattgtcagaccagaatcagtctctgccgagactcgctcgagccacactaacttagacatctgggggaatagattgtcgacatcaagatgtgagtattgggtggaggacggaggaggcatgaggaggagatgtggattcaagaaaggaatgagagaaagagaggagtgatgcatgaggagacttttcatcagtggggagaacattgttccttttaaggacattgaactccactcaaatgtgtcaattccgtctctaagcactgttgtgatgtgtggacttgacgcatcgcaaccaagtcagctgtatcaaaatggcagtgtgcaactggatgagctgactagtcgagtgtaattagaaatgagataccccagacaaacgaaacgccgcaaattataccagtcatccgtacaatacaatcgaccccacacgtctgcaacaaaataggatcaacgagtccccattccatgttgatctctcactctgcacccaggatagagactttgtgtcttcgtcatgaccgtactaacccagatgacaactcaagaacccggctttctggccacctcttcggtgtcgccagccaaccgcgaattcccagtctatgctgttaactggcccatttacacaatcccatcatgtctcatcattcccaatgatcaaaaggagctggttcctagccccgagtccatctccaaaaagcgatacgccacttctgtcgacgagcggaactaccttaccgtctacgagtaccagatcaacaaccagtggatcatctgggactaccacactggatacgtgcatctcactggcctctggaaggctattggaaactccaaggcagacattgtcaagctaattgacaactcaccggatttggaagccgtcatccgtcgagtgagaggaggatacctcaagatccagggaacatgggtgccctacgacattgcgcgagcgctggccagccgaacctgctacttcattcggttcgctctaattcctctgtttggacaggacttccccggcacttgtctcaaaccccatgagcctggcttcggctaccttcagatgcatttcaactccacgaaaaagagaagaaagagcaacgccaaagcccagcaacaaggactcgcccacgcaacctcgcccacacagcacagtcaccccacgtcgccatcgcacagtccccacagccatatgatacactcccagagtgtaccccatatggcccagcaccacatgtcgctgcaacaacatgtcgcacattcacaacagcagcagcagcatcagcatcacatgaatcatcagcagcaccacatggttcactcccatcatgtgagccatccccatcacattcagcccatgcaaagcccgcgctactaccccatccagccggcccagcaacagaatcaggcgcaacaatctcgactttcacagtcggccccagctcacgtgtcgtacgcaggcagccatagcaacgtaacgcccgtgcctatctcgccggctcccgctgcttctgccagcaacccctactaccacgtgacacctccgtcgccccattcacaggctgtgcttctgccccgcatctcgtctatgccaagtcctcctcagctgccccacgcgactcgaaagtactccaactccaagactcggcccattctcatccgacccaactcggatgattgcgcggtgaagacagagggtgatgaagagatgctgagccagcaacacacgcctccttataccacgtatgtgagccgacggccctcacttggaggcatcgcaaagcctggaaatgcggtgcggcctcgacgcaagtcgcgtctttcgtacgacgagtcgcagaccagtttattgagcgctgctctgagaagttccagttcagtgtcggggtctgcggtcacttgctcgtcgtcagagtctgagcaggatgacgatgagtactaccgcaacttctttgctcgaaggcagtccatctccgaatataatcccgccaatcctcccaagcaggagagtcctgaggagatcatggaggtgctgcaggccattcgttcgttgcagcagctcagcactggcggtgggaagcctggagaaaagaaagtgatggacatcaactcagtgttgagttaagggtataattttgggtaatattggcaccgaacagacgtttcggtgggtaacggcgtaatttattttgttaatgtattattggagtacggggtgtatggttgtaattgccagtaatgcgtggggggtatatatggttagcaatgcgctacagtataacaacgataggtgataactggtatctatatggcaatcggttgatttcgttctatggatttgttcagtatttggggtatgtgatgtgatatcatgcaggtacaactttctaccgcatctcacgacgcatagaaacagaaaaaaaaaaaaagaaaaaaaaaaggatggatggaggaggatcaaatatggaggagcaagtgatccgaaatatatggaaaattgaacctaagtagaacatttgcaacttgttacctactgttctatgcaaccaggtgctcatcctcttacatttataggttaggatcaccagtcatcggtcaatggcatcaccgttggaagcaccactcgctaggagcaggttgtaaagatgaaaatctcaatatattactcaatatatggagttgagttgactggggtgattttccaacagatcatatgttttttccggccaaaatgtggcccctgacaaagtttgaggaacatccaccccgccggcaaacatgtacaagacttcgtggccaagatggttaaggcgtacgactgttaggattagcgactccgaaatcgtaagatcgagagttcgaccctctccgaggtcgtctttttgtccctctctctgggctgtatcttgacctgtatagcttctacaagctgatgactaatggtaggctacaggacgtttattgatttatgttttcatgttactcgagagtgatataaacaggttagttgaccaattacttggaaagacggtattttatcaaaacaatcgtcctaaaagaactctccctgttccacttttgttcttgtcgctaatagtggttgtatgacccggtacatactgtatgctggtgatactaatgttggatacatggaactggttttactgagaagtggaaagtaaagatagtaatactatagatagttcaacaacaacaaatggtttggattcaacggaaattgggtcttaataacagcccctttctacgcttcacttcactttatgagttggcatggtgggtcatcgcctatcctggttatcgcacggcactgtaacataatcaatgttaaatatctaatgctatagcacgtgtcgagaagggtttcaagctctgtaatcagcttctttgagaaccatgtcacattacggtggatcccgcgaagtaaataccgcagagatgccgttttgaaaggatgaggttaaccaaatccagtccccggaggagagtgggaatagacctgagactgagggggtacggaagttagacgggttgcttaaaacgccttcgcgagatattatgttttgccatttaatggatcatattcaaggaggtgtctcttacaataccattacgagtctcgttgcagttactacgatacatggttcctgactatcgtcagtcttaattttcatttgcttttggccagatgaccttgaaaccttgacaggactgtaaacgtatctgaaagtaaacaccccgttgattaatatgctctccatcatctttagcgttcctcggacaatttttttggtcccctgctgcgttcgctcttctcattgctatatacactctacactatagtcaggaacaaggttgatgagataccaacgttggtgcatgtgaacatccagtggcaaatatcacgttacttttgccgttctgtgttggagctgaaatgggtggctggcggctcaatgaaatgatttggtacggtgcttttttgcttcagtctctttcctacatactaaatcacctcctttcaggaacccctttggcacgagacttcacgacatcttttagcttacttccgggatatccaaaaacctacataataatgtgtgataattcagtgtattgagtaaaaaagatagcattttgctgggggtatctcatggaagggacgaaaaatgtctactggaacacatgactaggttcttaataccccatagctcatctccaagccttcaatcgtgccccgaacaagaaaattaagttccagatttgacgcatgtgcgatgttatcggctgtgctacattgtagaggaacacgacattacgtcatgtgaagaaactgtcaatagtattttcttgtggaatgaaatgctctagatttcctgattccatcaagatacgtcatagtctcagatatcggtattatacacgaatgaccccactttgatcgcaactctattttatccatcccctgccctctttcagaaacccatatatacagcccctcgggagctgaagagatcagacgttaagttgaaaagtgagtacgaactctggaatctggtccgttggaataattttttggttgcgattgtgaacactgctggggctaccacccgtatagcactgctctgcactctcatggcatgtacaagacccctctacttgatactgcctcacagcgaacactagccagccacattgattgcttttttttcttgatatttcatggtattggcagcaatcatcatgtttccatctcattagagccctgtcatcaagcaactcacctaacacagtgaccctcgaatcttcgcttcacctcctcacacctgaccagctttcgtctctggcccatctgcaaatttccgtccccgagctctgcaagactgcccattatgccgagatttacggtcaccatttacttccagatcagaaatgccccggaagatactctgagaaggccagagatgtgattctgctgaaagtgttggaatccgaaaactacgacgctactaaggcaggagacaaactactaacggtgctgagatggagaaaggactacaagcctatggatgaagacagagacctaccagtgttggatggtcacgttactacagttgctgctaccaatctgcctcagaccacactctggcatcgctcttcggcaactcacattcccaactcgatctacattcgatggaaggttggattgattgagcaagctatcagtactcttgacttcagctctcccgacaactcttccaagctcacatgtgtcgaggacttcaaccacaacatgtacgatgaagttctatggaagcagctgagcaccctgagagagttctatcctggaattttcgacaagaccttttttgtcaatgttcctctgagtctcagaattggactgagattcttcaacaagtccaaccccgtgtacaaccgtcgaaactccgtcattctcggcaagggcaaggagttgaagaagcaccttggtaactgggtgcctcgagaatatggcggagaaggaccaggacttgagatccaaggaagaaatgtccgcggttattcagcttatgaacaccacgctttgcgacatgttctgaccacttctcctacacaatacagtcatgcgaagggagacgcataccgagacagctatggcccaccagacgatgacgatgttcctccttattaccattaggatttgacaatgatgatacctgttagttgaagggtgagctggttatcacccgtatggcataaatatgataaaaattgattatggcttactgtagcaaacgtatctacatatttgaatagaaaaaaaaaaaaagttttccaacaaaataccaactctaatttctaatactttttattgaaccttaattgtacaggaagcatgcatgtcttgcagaacctggggtattccatcgacacgagcaaccagctacttgaaccaggtccagttcaccccggattctgacctcttgcggcagccttggctccgataacgcgcaactccaatccgtgaccttttcaactcccgactccgatattggatggtgcaagaaccgactgctgttttttttctttcaatacggccgattttgatctgtgagaattggtcttcgtgtgaatggtgatcagatttgatacacgtacattcagtggtcgcaacaagtacttaactttaaaagtgggaggactatgatggtacccaaggagcgggtatgcctctggaacattggctggttacgacaggagtcctacaagcgagccagtacaccattgcgcgaacagttacaaatgccgaagttgcaaagctattgtaaggtcaagtttccttttccatacactcctcatttgtcacaccaagcatgccacaagtttcaccatcatcaactcattatccttaccccatacgacatgaatggcaaaggattattcagtggatcagatggaataagaacatgcgactagcacggagacgtcaggtggtacaacgcctctgatgtcctgggcaactcattcgaccaggaagacgagggctacgactttgatgtgtctattgccacatttcctgacccttggttgtggaaactggtaaccagaagcccgcaatgatcctccactagaaacctattgagatgacgatgatgtaccaaggtaagttcaagcgacttcggaccagttggagaatgctctcaagttgtcccatcggagtatcgcgtagacagttactacgatatccctggtgcaccatctcttacattaccatatgccttcggttcgagtgatgacagagaccctgggtctatgattacccttaattcaggagacaattccgccatctacctcagttctgatgatgaaggctccgactattactctgtagtcccgctcagctctacagagagtctggctctgttatcttagggggcctgaaagaaccagatacgaccctggcttggacgcaagtacacttcagccatatgtttcacctggtgatagtcagcgctcatactatgccgttaaatattctaggcgttctgaggtgttgactaccttcaatactgcgctcaaccactgcaccagacccgaagatgttcatagcttcgacaatcttcaagaggctgcatatttcttgaaacgcaggccaaaattcttcaagaccacccaacgccaacacttgaacataggtggcagacctgtcttcaaggtattcagtgacggatctagttaggtaggttttgacggaaaacagtggggtgatttgggggcatggttttgccattaccatccagacattgcggctggaccattgacgggtgacatccagaatcctctacagcaaagcttcgaggtctacttgaggcgcacgaggtactctacgacagatatgacgatctcctgcttacaatctactgtgactgctatgctgtggtcaaaaaacttgacgcagggaagagatttccacgtaagtatcgcaccaccatgacaaccattcgactatgtaagcagttgcttgacacgaaagtgatgctctggcgtattgtggggcatggtggtcaccctggaaaccaaatggcagacatattggcaaaaacgagaagagtccgaagagatggtcgtatctcaagcattaatgccatcgtggaggacagatacaggaggaccataggcgaagactcagcgtatccattcaattgagtcaagttagaccaactgtctgacagaagaaatcggccacaaatgatgcgaacgcagaagaggagagctttggtttactgcacgtgcacggcagtgtgtaatttatttgcatttaatgatattccatgtattttactgtaaaatcgccacataaccattcataaatcattagtattactacaatatgtacaatatggaatcacacaataagggacatttcgggtcacagtccttagcattacacccactggtcatcccagttgaagcttccgaaccagttgtgagggggttccctctcttcttctcctccgccgccagtagccatcgctgccccgaataggactccctccacaccgttcgggttcatgagcttctggagatcctgaggtggtgaactaactgtttgctgatgggttaggacagctcggttgaacctgccgtgattgactgcttgactgccatgatcaataccaacagcgcggaagatctgttgggttcgttgaagacgcaaatagacggcgtggttgagagttttcagaccccacagaatctcgtcagccatgatgaacttgccagacaactgcaggtcagttactagagcaacaatgttgccgaggttgtcagccaggttagtccagtcgataccaacgttggcgaagcagattaagacacatccagtattgaaaagtgtactgagagtcagccacagcgggctgatcaagcacttctctctcttcatgacaaggctgagcttgagaagaccatgggctgatgataatagaccattcgtcgagcctattccgtcatatctgatacttccaccagaagaaaactgcaggagtgtctcgacgttgaatatgtaagtcactgaatagtactgttggcgcaggaaggcgtatgtggaagcgtggacgccgggaagacgattgagatcatcgtcgaacccaagaccaatggatttcatctcctcattccaagcgtggagtgcattaagcatgatctttttcttttcaggttcgaagatctgtcgctcaaacctgaagcccttacttggcgagtatagagaaatgacatatgctagcttcagcaaaccataactggtaatactcaaccacccatcattctggtaacttgttggtcgctcaaaggtaatcgcatcatctctgaaactgaacggtcttcctgtttcaagagacaggattctgtcccatgtgtaggcacaccaaaagacacgctcctgcttctgacggtcaaacgggtcaagatcctcctcatcctgttgcagatcctcaaacagatacatgcccatacacattcgagttgcttgacccaatgcactccaagctgaactctgacggtgacacattcggagataaaatgtgatgagcagccatccctggatcagatctaatgattgccattcaaatgacaatgcctgaatggtcttgtaaccatcgtcgaacagtgtctcttcaagatgagcttcgaagatctcgtttgtagtcacctccaggtatcgcatggcggtggcacatgcaatatggcagagggcgttgaataaccgaatctctggcttgtcacatgagtctgacggaggatctgctacattaacaccggcagcgtcgtgtgatgatgtaggtgcggggtcgacttctcgagattctcgtgtttggtaaaacttttcaagctgagttcggaagactccttcgcaaagaggcgaaaagatggggttcaaaaacttgaaatagacgtcaatcagatgccatagacggacttcggtgatgagtgggtccgacgaagctagagatcgggatttcaggtaatggataccactcatattccatccatacgcctggtaacgaggaactgcaatcttcttggctccttctttgcccagtccgtcttgaatgcatttggccatgagcggagcaatgtagtaagtgaagttctttgtatatttcgtttttcgtatgggtggaagaatggtggatggaacgttcatgtaggggttgctaccgccaagactgttgggaagaccagcgttgcttccatgactacttccctgtgtgctgtcatgtcgaggatgttgattggggagaccattaactccgttggcaggaatacttccgggtcctggtagacctgtattcacgttagaaccaatgtttccgttgatctggctgggttgagtgacatgagcctgtccagaggtcacttcctcatccaaatgattactctcgtgtgttgctcgaatgccctcggagcatggaggtccagggggcatagcgatcaggtgggcagtgtcgcgattctcgtcctcgtctttgtggtaacattcctggaaggtcatatgctcacgttcagctcccagatacacgcattgggcacctgctctgatacacgtttcgcaagggaactttccatcgcatttcacctttctatgtttgcatctcttgcatgctcttgcgactttctctctcttccgtttcttttctgggggactagtagtgctcattgtcgcgttaatgtagaccgtgttgatctggacgatgtaggaggttcgtacacagtggtggtgtgcgccctgactaagctacgttagtatgatgttggtgttgagatctgttgtatcaggacggcaatgattgtaacatgttgtagcctcattgtgttatcattccactcaaagtgtcgagacttctgggtgaacctagaggatgggtcacacattttccctgtcagtcataaaccatggcaaacagtcacgactcacaacatgccaccaactgaacaaaaaatacgacaaccattgcagcctcgtgtatcaccgacgagccggagcacacgacaagtgtctcgaggtgaacacgtagggcaagccatgccttttggacacatgaaacagcttgtatctatgagtttcccatgtctcgccaccttgccacagccagtcactcgacagtcatggggagttcctgcgacgtggcacacattgatcttgtgcgctctggttcattccctagttacaaacattgccctgtggcaagtctccagcaatactcactttaatgccgtacgtgaaggctcgcgctctgctcaagatgcgaatcgaacggccagtttttcaaagagcttcctgtttaggaaggggttgtggtcgggctggtcacactgctgccgggcaacgctggggtctcaactggctggaatcggcgtgcttctgtgggtttgtgcctgacgattaatgactgttatgaaaaaacggaggatgcacggcccttagcattttgcagccgcatcgaagtcacgtgtatgcgagattgtcgcttagagttcagttaacgatgtaggtttccgataaatttttggaaccgttgtgttttttcgcagaatgactggaagacaatgggattgacatggagaaacatatgggcgcttctgttgggtctgaactgacacacctggatgacgcttcttccttttcagctggatcttgcaaggaagctatacatggcggggtgatcagaaagtcgctttttctgtcacacacgtgaatcctcgtggaagcggggcaatgggaatgagcgagaggccttctccagcgtgatacttcgatcgtaccaaagctacgtgtatcgaattatttgtacaagtatggtactgtactcgtaggagaaccgcaccaatacccgtactgtatccgtgcagtacatagtcatacatggttgtagtgtcattgaaccaaatgtttgcagcaggttgaatgagcatctccgaactatactacttcaggagtcaagatacaagtgccaatatggcaactgcaagtaatagtggagtgctcgacaactcctaagggaagttccagaacgtattctttccgtgtttcactgaggtattctcactcactgggcatgatggaagctttggagagaaggagacttgatacactttggaggcaactgtgtaggaaaatatctgttgcttcaaaacgtatcgcggctagtctggaactcggaacggctaggattgggttgtacgtgaacagtgagtgagggagaaccagagtcactctctataaatattccggcgttctccgcgttctccgcattatcatgattctacgcggtctgtcttaccccattgtagttgagagtgcatgcaggactacattccagttgtaggacatctctgaagcggttagcaactgaacttggagctctggaagtgacttgaacagttgtatctacaggatcgttatattgctttccttctttttgccagagagattaccgcgaacaacaactggttcatttctttcctccctctccatttttccaatattttccatttgagtttcatacttctccaaattaatgaccagttgtgcgtacaatactcaaaccggcaccggtacagcagtggcttgcatgtgcatgccactttgaacgcaacgatcgtctgaagatttttcctggcgtcgggccgaggtatgtcacgtgatgaaaacttccgagaaaacttccccgaggccattctcgttcggaagcatttttcgaaccaaaggaatatgtttccggtgtgaagtttgaagagtgcaaaaaaggtgcacttgctgtaatgtacatactgtactggtggttgtaccttttccctaatcgggcaactctaaccgtatatcaacgaatattcggataaagttccttttatatcgccaagtagatcagttgaattttgtagagtggattttgaagagtggatttggaagagttgaaaaagttgaatacagtacaagtacagtagttgtagaatcacagcatgttatgtctctatgtgtgcttgtccctcagacgaacccactactacaaatgtactcgtacttgcacttgtacatactgtgtacatactcttcctttctgctgtttggagcgcttccctttctccggatatgggtcatatatgtctcaaacgagcggggaaaagtggacccgggagctaacgtgactccccaggttttctgtggtggttttcggtctcgttttagctctctttcgtccccttcggctatgtacggtctcatttatatgactcttaacactggcatggatagatatacttctatatatacttctcccaacagtaattaattgttataaccacagtctatgtcgatgtgtccagaatgtgagcctatagtgccacagcaatagagattatattggcgtgtgtaacacgagccggagacaaatattgttcccagaatgttttttgtcgagtcactccatcactttcaaacttgaagcacaacttttgtttggacccgctcatattaaacttttccccatcccctatcccgaagcttatcctttatcggcgataacaagcgcctgaggcgtgatgtgtcatgtaccagtgggaccttggagaacctcacagccacccgggttttacgaggaaagaatagaaaacaggaaatgggggctatatatacccaactaggtgacccccacgctaaaaaaatctaacattaaaccacactagtggcttgagagtgactcacccctcaactctaatgctggtctcgtgatacgctcttatcgtgcatagcaatgcccaacaaggaccctttcccaaccccatttatagccaacgtcacactgcgctcttttcacggttcttccttatcgataccaccaccacgatttcctcataacaagtgcatttatcagtcccgtgtccaccacagtcagctcgcaaccactaacatccactctcacactcacaccacactcacactctcacataaacatgtcgtcacagtcaccacgctcgaccctgctgtcaacaaccatgctcaccaacgatgagtactcgtactatgacatgggcaaatcaccagacggaatctgtcacgtgactatggcgctgaaaaagtcgcaggggtttgtgtggaaccaggacattttcgtctcgaggtaccaccaggctcgatgtggggagtttcagcagtttgacgaatgtacacagacagaggtccaggaaattcgagtagacgaagacgaggaggtattccacatggataagtaggtaataatctaacaaagcgaagttcggactgtagttaaatagcgatacaactgtgcacgacaaggtgtagtgtaccagtgtaaatgaggacagcgttgagacgtttatatatggccggaattgaacacagtggtattgaggaatagtgatggctatgttcctctgattaaccaggtcatatactatcaatactatcgtagacactatcgtaggtacagtatgtacttatatttgtacttatagtagattctcccacctagttcaattggagataaattactatatatggaaagaagaaggagcagtattaaactgggaagttggtcctgacatttatatgaagatctgtgtgagtaaagtagctgtttgtatctgaaatggatattcattgctgtacaactactcatcgtgctcattcagtactgtggccaccagtagtcaatctccgtaaacatgccattgttatattcaaaatgctataaacatcctcgagtaccttcgataccgtctctatcataattcatctattctcttcagacaacttcactaacctgcaagctctgatcgtacaagagtctctccagcttagccagactctgctggaacacctctatcttcttgaccaggtttggatcacctgtgagcacgaagacagagtactcgaactcccgcagtaacgccacaattggcaatccatgtgctttgttcagagttccgtatctcattagctcaccggtcagatcaaacagaccagaaatgtagtctctaggatggacatatacatcaatgttgtgttgtttgatgatctcatgcagctcttccatggtcatgatctggcccctttcgagccagaactggaaagacatggcttcaatcatctcctccgaagctccagacacctgccgagagtatttccagtacgcgtttgtgctgttgccaactaaactgttgatctcggcgaacttggcagcaatcagcttgtactgagacgtcagggtcgcctgtacgtctggagccaatgagagcggctcctggccattctttttgaccctgtgaagtgcaaaaatgattttcttgctggctgccgtcacgtctcgcgaaatgttgatgacctgagaccgctcatcctgagagatgtcgaggcgtgtcttgaattggagaaaaaagtttttggccgtttcttccgtgctggactcgattttggccaccttgacgccctcctcgacttctgtttctgtgtttcgtttcagtgacatgtcgtgaagaaatatttagcctccatgcaggaacttgtgtaaggtgcatgcaacgaacccagcacaacccagtcagactcagaactacaagatttcattattgcaactcagactatacaaatacaataaatacttttaattatgtgcaatctgacggtcaatctcgccgatttccgtctgaagggaaacctcctcgactgtcttgaccaactccttggtacacttggtaagatcaaacgaaagaccagcaagccgctgcttgaactgcttgggagggtactcggctccgggcttaacgaacttgtcgtccttgaagatcatcttcattctatccgtgcaggcccgcagatcctggcaaatccaagtgccattctccttaagcagatggtttcgagtctgggccatggactgagaagtggcatccaccatgcatagcacaaccttgcaaatggctcgagagtgagcggagatggcaatcatgttggaattgcccttgatggctgtcagcagattctgaatagcctcgatgacttctacacactgctcctcaaggtaatattgcagatcctccacggtgttgtcgggatcttcaccatcgaatttgacggccttgggcagataaatgcccagatccgcagcaatgatctgctcgtcctctgactcggactctgactcgtcctcatcatcctcttcgtcactgtcctcctcttcgctgctctccagctcactgccgtcctcaccactctcgatctcctcagagtggccctcaaactgatgttgagccactttgacggggggaacatgcccatcatcaatctcactgatttcactggtgagagactcgcgaggctgaggcgcatcctgcacagaagtgacagaatgggtcagtggagtgctgtgattgtcgtagtggtgaccctcgtgatcctcgccgccaagaagagtgtcgtagtcttctcgagacttgggtgaatcaacacctcggggcttgacattgccatcgtcgctcatctgagtgagctccgtagtatcatcctggttctcagacatgtttgacacatgagaaatgtcaggcgactggctcacaacttcccgaagtgcactgggaagctcaaaagtggcctgaggatcgaaagactcctggggatgaaaggcaccaggagaagacattgaagtggcagaagagtccagagcaggggaagcaatggcaggagaggcgtacgacttgccaagggccgaagcaacaccagtaccagccatggaagcgcccacaacagcagtagcggccatggctgcagtgctgagctcgttgggggttggtgcatgaccatcgaccccactggaagccacatggggctgaatagactctgtgtgagcatgaacaggctcaaagtgagcatcctgaaagtcatcttcctccacttcctcgtcgtcatgctcgtcgtcatccccgtctccaacaacagcaatagcgcgggtttcctcgtcagcacgcttctcagcagctcgaagttcctgagcagacacgtagtcgtatcgctgaatttcgtggagaggaccgtcgaaagtttcaggctcagcaggaccgtcctcaccgttgggatgacaatcaaagtattccttgttggaaccagagtacacattctgcccaatggagtatccatgtccctcttcggcaccgtgctcacgggcattgttcatctcacgagccttgtcgagaacacggtcctggtccagagttcggggctccacgtctgcctgatgagacgtgaagttgagagcctggctctggcccgctgcttgcaaatcccgaggcttgagctgaagaccagattcggcatccagctctcgaggatggaaatcaagctcagcgtccaagtcacggggcttgaactcggtgtcgagatcccgaggttggaactcagtctctgactccgtctcctttaaaccgtccttcttcttctgaccgaatgaaagagcagccactccagctgtaacagcgccaacggcagcaccgaaggcaccgccaaagccgttggtcgtggaagaggagtccgcctccaccttttcagacaccttttcaggcacgctgtcagccatctctctatcggccagaggctcagaaaaagaaagaggcccagcagagtgaagctcagtagagtgaggctcagtggagtgaggctcagtggagtgcatcgaaagaggctcagtaaagtgagttgaaaccggttcagcggagtgagtcgacaaaggttgagtagtcagaggatcgataggcccagcagattcctcagagatctgtcgagatctagtcttgggaacgttcaactccgcaacctgggaagaaagagagagggtctctcgaatggaatgagactcgttcttgttaccatcaacatcatgggggatctcaggaagctcatggctgggatctcggcttaattcttcgccgtcacctcgcttcttgttcttgtctcggagagacgaaggagccgaaacgagtcgcagagttcgtagccggctgttgcccttggacggtgtcttgacgggtgactcgacggagactccctcattggaagataaggagtcagatcgagatggaatctggtggggaggagtaagtccgtccgtctgggaagaaggagaaagaggatacgagtcaaagctcacacctccagcgttagctccagagagacctgctcgaattggagtatggttggagtttgtagaagcagaagggtagcccgaaacggacgaaacagaggtgtttcgagtggtgttgcgagtgctgacgctgccagcaccgcttccaagagccaggccaagaccctcgcgtgtcagagcacgcttctcaccgttctcagaccggatcttggcaaccttcacaagctcaatgacggcacaggcaagattcgccacagaagcatccaacaagtagatagggagcagaccagacgacgtggcgtggttcttagtgcacgtgatcagttggttggcggtcttggaaacaatggaagataggttggaaaggagaggagttcggtagtctcgagctcctccctctgtagacacatcattggagtcatcagtgacctttcgagtagcaacaattactctgtgaagatgatgaagaagctctgaatggtcgcttccaacatcccgggacttgagcagatactcatctgtggcaagctggaacttcgtgagagacacatcctccaccagaccatgaacttcatcaacaaagggattggtagactcaatggcaggctgaacgattccacttgtgccataaacagacgatcggagagaccgaaccgtggccttggtcttagagtatcgagccttccactgctcaatttcggccttgagctcgttgacctctctgagagccacctcgtggtcgtgagacttggcagccagagacttcatctcagccaggaaaacagcagcctgcttcttgacctcggaagtcttctctctctgctctctgagctggttctgcaggttcagaatggcttcagagtccatatcctcaacagcaggcatgctcttgtcaatagaagtgtcaggagagatggaaggaagacgatcgtagtcaatacctcgatcgagacctcgctcacgagatccagagccagaaagagcactgagagcagcagctccggcaccagctccaacccctccagcaagcaaaccgttgtgagagctctgcttgagagcctcctttcgaacagactcaagctcattcttatgctcaatattcacctgctcaagctctccctgaagtttgtccagctcaacctccttgagctccaattcagcctcgagagaactgacacgggtagccagagaagtgtaggagtcatccaaactggattgtttatcgacgagagtctcgtggcgaccccgcaagtcctccaggtccacatctcgtgtgccaataatctcccgcagctgtgttttttcctcctccaaagtctccacctgggcgttgcaggtctccacaagacgcgccttttcggactccagcgacttgatgaactcgtgcagctgctcgttttcctccatcaagctcttggacatgttctctgcgtccaccagtttgtttttgaggtcctccgactcggcagaagcagaagcagaagtaacactcttgtcgttcggacctctggtggctgtgttggattcaaactcaggctcaaagtcgctaggagtaggaacatgtgtgtacccaacctgggtgtgacctgtaggtccacccagaagctcgtcgtcgtccaattcgggagagtctatcaccttagaagtatcaacgtcctcgggatgaatggtctcgggatggaacgagtggctgttgttgtggttgtcttgactgacgtctctagtggcactttgaatgtcgtaggtaggagcgttgttgccaatgtgatgcctgtgttcactgctggtctgactgacatttctagcatgcaaaggttgggtgctgttggcgaagtcgttctgagcattgagtgagttctgaccatatgcagcaggagtggcagtgtgatcctcgtcctccacataacgctgatcttgcccctcgtcttcattttcttcctcctcatcttcctccgagtcggtctcttccaccagcgtactcttgttgggaatgagcgtcttggattggagggtgccactttcggggaaagatcgttggctctgttgactaggagcgcggtcgtgctcgccgctgtggttctcggtcacgtggctgtcatccacttgaatagccggtacggcatccactgccactccatagctattattgtcgtatgttagtggctgattggtgacttcgaacgacgtgtccggatcgatatctgtcggtacatccatgtggttgttgtggtctttgttgtgaccgttggtgagtccgtcctcgtagcttctatcattctctagatgcataggcacatcgacggcatggcccatggtgtgatcctgaagatggtggtcttggggctggccaatttcgtgcgcagcaacaccgatctcctcatgccgacgctcaatctcgtactgaatgtcactagccaggtctctaaaccgcgagactggcagagtggacagcttctggcgggcctgatttcgcttgggatggaaattcgaccgcggagctagatagtcttgggtctcgtagctaagaccctgtcttcgttgcagttcgtcgtacacgtcggtcgagagctctgcaaattgcagacgggacagcttgagcagcttttcacgggccttgtggacccgtgcggacgacgacgcgctgcgcttgatgtccgtctcgtgttgttccgtctgcagaaactgtttgagtgacccatggtgggtaaccaggtcgtccactgcgttaggcatgttcatgaagttgtgggtgtgaatcgggtgtgatggtgcgctcttctagatgcgatcatccaatgccggacgctggacgccagacaccggacgtcggacgctggaagcaagcagaagcgcgacgctttcgtgagccccatctcttattctacctgtgaacccagcttcgattgttggtccatctccaactcgttttccggacgtgtcgcgtagtctggtcttgatcacggtgccaattctgggattggtccgtagtactcacttgtatgtccacgtagtctgtcgttgcgagtggtcgagacggtgtgtatagcagctggtgggcttttgttggtggtggtgacgccggagtattcgcagtagcggtggtttagcagaggtgagccactatactaattgcaaatacggtatagtcttttttttatcctttgatgtgcgtcggcaggacgtgacgtgcctctacagttaatgtttggagaagagaaagagagactttaaatgaacacagcaacaggcgacaagaaaaaaaaaaaataagagcagcggagtgaagtgagttccacggcagatgtgtcgtcggcgtttgcgctcttggggccaatctagcccctgctatcgcgcgcgacacacgaccaacctgggtcccccgtaacatctacttattagtccctccccctggcccaatggctggttccgctgacctgcaactacacgcccccttgggactatacaatataaacatttgcgttgaagacgcgcatttcgaactctgcgcgtggaacaaggaactctcccgaaacaataggccaagtacatgctggttagcacctcgcctcgtagaggctttgacgtgcccacaggtgggcatgtcgcagtagacgggcgatttggcggcttgtgtggcagtggggtcctttgatacaagtagcatagcctcatcagtgcagtgcagtgtgcagtgccaacgtcgttgtacagtaaatcatagcccatgttggcgatcataagagtatacagttgtacatacaagtacttgtagtcagaagtgatggacagaaaggtgtgtttgcaagcattcctggagccgaaagtagatcgagtaacggcgctggctgaaagattggccaaactaaaacgcttggtttatcgtattgtggagtacgagacatggaactatgtggatccaccgtgaatgtgagcttgtatatgaagccacaaccggacggtcaactacaatgtaggagataggcacatgtataaggcggtacaagtactcgtactgtcgatgaaagccgaaactgtggcgacattgaccatccacacccatgttgacggtcaggaacccatgccttaggctgtccgggccctggcgtggccgttcattgtttgcacggatatggacaatggcgtgtagatcgcgtctctgagacaggtcggctcggctcgaaacatgcctctggccaatgcagtacaagtagtgatactgaggcggttgtggtgtgattgggggggagtaaatgccgatgtatcgtcgttaagcccgtgttaaacgtcggtattacgtctttattacgctaccacacaccactcgtaactcttgccagtctctcgtacggaccccatcctgcgtccctccagtgtcatgcagcagttgcagctgactgagcggttaacactattgcggaattgcaagacccgaagagagaaacaaaaacgtccagagggatgcttctcagaggcgaaacggtgggaacgcgtttcgacgcgtcgaccgtcgctttcagtggagccctgctcgagatcggagcggagatccaccacagccgcttccatgatagacccaaacggacgccgggattgaccgctctacagaagatcgcttatatggaatgtaaaaaggaatgtgagacaacacgagaagaaaagacgacgaaaagcagtcacgtgtcgttacttttggtcccgtggcacgtgatcccgagcgtcccaacccaatggccaccggccctgtcgcggtaattacagtgccttgcaacgcaggggccccagttgcatcatgtacgggtttcctgtaatgtacttaccagtacaagtagacccttaccacaacatggcatggcattaattggttctttttagcgtccatgcgtggttggcgcgggtggagtgggacagtacaaccataccgtacgcgatatcgtgcgaaagacccgccataattgcaaccgtcatcggtaattgtgtattggcgctcccattgctgttgtgttgcaccactgtatgtacatacttttaacccgttactgtaaaatatttcagtgtaatcatacaacactctaacaccacgcccctcagactaatgctcatctgggttgccaggggttgccagtatatttcgggtctaagattacgtaatgttgagatgaaatgtgttacttctacttttagtgttccaggtgtccatttgaggtggttcccgttctgtggtcgtagtagacttgtctcgtcgtctcgttgtctcgctctctctgtcgaacttcccaccatttaattatgctcctgagcagccaaagtttccagcaagtacacgtgcattagataacgatacgaccactgcttctcacagctcaaccatgatcgaaatcgccgcctcggccgccgaacccattctcaccgtggtcgtgcccggcaaccccggcatcgatctcttctaccgcacctttctggcgcttctggcccaaaagagtccccgtttcgacctcgtttgcgactcgttgagaggttttgaagaagaggaggcgctggcagaggctgcagaatcagagtccgggtttggactccaggaccaaataaaccactttgtggcgctcgttcgaagcagatttgatcctaagaaacacgttggtctcatcatcatgggccattctgtaggagcttggatcgtccaacgagtcgcctgccaggtctccactgaagaccccaagatccccatctctctcgttggcctgctgacccccacagtcaaggatattgccaagagtccccgaggatcttacttcacagccatggacaaacgtatcggctactacgcccccagcattgtgttcacggccgtgcgagttgccaattggatcccgggctttgtgcctttcgtggcgtcgcgagtgtcgtcgcgcggggccatgctgccccatacagctgcgggagacgcgcaagacccctcagaaggtaacatgggagcctacgatgccgtaacccggtacgccaccaacccacgaatggtgcgacagacagttgagctggccaaggaggagatgcgggccattgcttcggaccctgaacccgctgctatcagtggcttctggaagacgcttcccattttcggcttctttgctaaagacgaccactgggtggccgaggagactcgcaaggagctctttgaggagtttggccacctacccaacgttcatttcgtcgtcaaggacgccgctcacgcattctgtatccgagaaaacgaaaaggtcgtggatgccctgttcgccgaccttgagggcagaaaggtggtttgatggaagattggcagtaacaattcaagtacaagtaggtacagtatatagagatagattcaataatgtaaagacgacggaaggtactggacatctgtgtgtgagctgagggttgtatctggactacagtgtacttgtacgtgtaccagacccagctaacgaaagatatcacggaactttcgcgaaaacgaacaaactaaactaacttgtacagcaaacgaacactttagccgagatgatgatacgcgtttgagagtgaaacagagagatccaagaattcacgacccttgtgagatattttaaaaaataaaaccgtgaatgggaatgtgatcctcgcaacacttcagaaatgtcgagcttgttgtatataatcattatcaatcctagaagaagcttctcctctcgcccataacccattcacgtggaaacactttaggttgacggtttcccggtttacattaagccaattgcagcgttcgaaaatctaccagtatgtactgtatgcacagaaccaagagtgtgctcctcaagaacggagatcaatactggtgggccgccccgtgaattctgtgtcacgtgacagacacgtctctgtcgcggcctgaacgctaaaaccacacagcccatgatttggttgctgaattgtgacgtaatacggcttgaatggggaccctccgatcctgtcaaattaggttatctcggctaaccgagatgtgggggttgtccggttgcgtgtaaggtccgtttatacaggttttaggaggataatatgtttataagaatgatcgcttagttgttctgcttacaaatcaatttcaacaatcgtggtagcttgaaaactggccaaaataatccggtctgttgtgtagtttttgtaatttgagctacctcccatttcggttgaatcctcctgtgacaaggcattggggtattttaatctatcccgcaaaggagtcgaaaagggggtcttctggcaagtatttttgaagtttgaaaattgcaacgtgtccaaaatctttcggagactgcaaattcatccctaaattcacaaatactcaacaagaacccgttatatctcctgggtttacgtatctcctactccccacctacccggttagattaagttcgcacatgtcccaagatcgcttatctagggatgcagtgtaacactatagacacctttcgacgacgctgtcagtctcacacacaacacacactcattagatacacgcacacgacacacacaaaatggatcaaaaaaccgactcgcgcgagtatctcgacgggttcaaggccggccagaaggtggcgtacgagcggctctactggcgacgaatcctcgtgctgtttggaggtctggccatggtgctgggtttctttggctataaaggatacgctgtcaatgacgtacttgacctggatctgtccatgtcgcgagccgactctgtcaacgacaatccccttgtttctcctctgtccaagcccaagaaaaacgtcatcttcatggtcaccgatggtatgggacctgcttccgtttctctggcccgaacctaccgacagtacgtccagggactggcctacaacaacaccctgaccatcgacaagcactttattggctcgtcgcgaacccgatccagtgactcccccgtcactgactctgccgctggtgccaccgccttctcctgtggtgccaagtcctacaacggagcaatctccgtcacccccgactataaggcctgtggcagtgttctcgaagctgccaagcgacaaggtctcaagaccggactggtggtgaccactcggatcaccgacgcgacccctgcttgtttcggagcccatgttgctcaccggtctcaggaggacgagattgctgaccagctgctgggctacgctactcccctcggccgttctgtcgacttgctcatgggtggcggacgaatccatttcacaaccaagggccgacaggatggccgtgatctgattgctgaagcccagatcgacgggttccaatacattgccaaccgaaaggagtttgacgagctcgatacttccaacgccaccctaccccttctcgctctcttcaccgactacgacatgccctacgagattgaccgagtccccgagcagttcccctctctcaaggagaccgcaatctctgcccttgagattcttcaccaggagaccaaggactccgacgagggattcttcatcatgatcgaaggttctcgaattgatcacgccggccaccagaatgaccccgctgctcaggtcagagaggttatggcattcgacgagatgtttgctgccgtcgttgactttgccgattctcttgacaccgaaaccatcattgtctccacctccgaccacgagactggaggcctggctatcgctcgacaggtccaggctgagtaccccgagtacgtctggtaccccgaggctcttgctgctgcacagcactctggagagtacattgctcgaaagctgcaggcgtttgctcgacccgaccacccttccgaggcctctggctcgaagctggagaagttcgtcaagcgagagatcctcgagaacgatcttggagtcaaggactacaccaaacaggaggtcaaggctctgattagaaaccgggctgaccccattgacaccattgtcgacattgtttctcgacgatcccagacgggctggtctacgcacggccactccgccgtcgatgtcaacatctacgctcactccaacaagcagagcggtctcgacaagttggatgctctgcgaggaaatcacgagaacattgagattggtcagtttctggccaagtacctggaggtggacgttgctcgagtgacggagattctcgaggaccttcccgttcgtgttcagcacgttgaggagattgatgactgtgaccagtaccatcatggtttgtattaatcagcgaagactgcgacctagtatcttcactgcgtgacatctgtaaacctattgtaatagtatgattatgaattagatgagcaggtcacactactggtattttttgtcattgtgacagcagctaggatattatgtcaagaaagtcgcaaccaactcatattatggccaacgctgacgttgatctttccgcgttgagtaggaagggtacatacaccacgtcagagaaacactcgaataagggcgtgaagatagtcaatagagatgcactgcgaaatgttgatgaacagggtatttcgtatatcaagatcttatcaagattttatcgagatcaaaagaatagagaagaatgtttggattcatagatcctaggatgtactctgaatcatcttcagttttcttacgcaaggatccgcagataggttagcaactatcgccattattgagcccaatgagtgactcctaaggaatataaatacccctttgaggtcccatttttccctcattagaagacaacaggctctgcatcccttcgctcggggactgtttgtttacaggagatgtttgggcatcggctacgacgaattcttgcttagcagatccaccaggacacctctcttcatgcctcttttgacatggagctatgacaagtgaaataagcaatctccttacgagctccatttcgagaacgggtcactcctggggtggaaatccctgtatgaacaacacttctgaaagcgagtaactaagacgttacgctgagcgagagctacgaagctgcctggcaaaaggataccccttagtacatgctgccgttggacgcaagatggtgactgagtcaagcctagctatccctcaagagtcctgtctcctgtaataagctgtgacgggcacgataggttgccaatgagcttgctatggcggacgctgctgtgtctagtgcgtgttcaggtagctcccagggtgagattctcatcatgggtaacatttcctaaatgctatggggagaaggactgtcatttgcacagacatgtcttcttcatctgatactgatttgttatctgtacaccaggtattacggtatagagtgacagttggtgatgatcgcaacctgatctcagcttgcaagcaccattggacataaacgtctgtggggaccgcctttgggcaaagtgtttaggccactcctgccaaaccgccaagtaaagagttcttcagagcgaccgaccgaccaatgtcaacactacgacaacgatgaaaagccgtttggagctgttgatggcgaaaaccatcagtcgccagaaaacgctagttaaagcgactgagacaagttgagtctgccgagcaagtgatactgtggaacgaaagttatgccaacacttgcttctgtgaaacgatgacgccagcgcagggtgacactgtgaactgtgaccagaatgccagcgccttgagaacatgggccagagcaaaccagtaggagccagagccatgttactagcctaagagacaaatgttatgccaatgagagtcagagccttacagcctgtgccagtaagagcaggagagtctaggtattaagccgataagagccagtctggatgtggtaagcagacggagtctgattggcattcagaaaggatgcaggcgtggaacctcgcaataaatatgtacaccagccgaacctttaagagtacataacaagaggctgtaggcatagagctctgggtcccctcccccaaatcttccttcgtagtgtagttgtgagttgcgattgtaatgttgaacaccgtcggaaagagaagatcattggtccaagtagaatcgactctggtgttaaaagactcataatggtgctagtatttggtttattaccctagtgtctcattttgcttaaatatacagtcgatttttggacctgaacaagacctcttcgagtaacctgaatcagaataattggttagttgatcgagagattgaacctccccagagcccataaaaacaacgaaagtctcgtggaacaaaaaaaacatttataagatttgtttattctaaaatcacgtgacacatatagccggatagaactcacaaaatgatcatttttccagttgcggccatatcctggtgaaaatacggcttcccgtccgatcagccatagtcaagcaccagagagcctagttagtattgtagtgggagaccatacgagaatcctgggtgctgcaattctttttcattcttaattgacagtctttttatgtctaactttctctttttcctttctcttcacttctttttgccactctcctatccatctatatatcgagcatagtaaccttgggaaaaccgtgtcttgaacttagacgccgtacgtacagaagtattcgtagttatttgaagggtgaaggtttttacaggtgtgtttgtgcagtacatactgtaaccaactgatcatagacctactcagatgcttgcagttgtcgatgctttacagtctttgtacggcagttctacagttctcgccagttatgctggtacggtgtattaatatacatgctaaaaatgcaaaggcagctgatcaaactgctgcttggttagttgggccacctcctggttgtggtggatgcaaaagccatggatgatttcctccgctcccacgtcaaaggtgacgtggttcaagtgtccccactcgttgaagatatcctgtcgagtctcgtcgtcgacaaactgatcctggtgggcaaagaagccccagatcttgaattttccgttgttgtgccaaaaatcaaccacatcattgcagtcggttccaatggccaccagctcctccttgcccatctcgatccattgacggatgatcgagggctgggaaacaaatccccgggtagcctgcacaatatgaggaggaagagcgtcgctgagaaattgctgctccacccgagtccacagaggagacaccttctgggccacctgcaggcctcgagccagaactccgccaggcacagggtactgcttggctagagtcttgagcttctgaccagtggagctcttggccagttccttgagagtcggggtcatgagacacacgagctgcagatcgatctggggatcgttggcaacagccacagccactcgctgaaccaaccagcctcccagagaatggcccattagaatcaccgggcgtccttcagtctcactttcagagatggagcccagaagagtctcgccagaggaaatggaacccatggagtccatggaatccagagagtcgatagaagaccttctggaggaaggtggggtagcgaaagaatcggccagagtgtcgtcggactcgtagccatcaaaagtacatgtctcgcacttgctctcggccaccacatgtctcagaatcttgaccttgttgtcaatctggtcctggagactgtacaggtcctccttgaacgacgccgggttgaaagtcgaatatcctctgtagctgggacacacaaactcgtatgtggggtacatttcagccaggtgttgcaaaaacacggtgtagtattcggagattccggggttgccaggaatgaaaaaaaccagaggagcaggtcccttggagctctttttcttgggtgcaattcggtagactgctgtgtccatgatttcggagtatccttcgggcagacacgcgggcttgggggcctctaggggctgctgctccttggaaagacctccctccagtccctgcttgaaaattccaatggctgatacggggttgataaagtttcgaagtactcgtactgtcgccatcttgtcttgtgtgctgtctgtgtcttattgaaagtaaatctgttgaagattacgcataaaaacagtgaagagtcgcgcgaacaggtcgtgtgagaggcgcctcagggtctatatatactcctgcattttggatttgtgtcacacgagccataactctttttcaccctgttttttttgcaaatcttcgcttttttgcaaatttttaaaccctattggcctcgacacaaagaaagataatgtacatggtcgtgtgggctgaaaaggctaatttagaacgacggaaagcacggcccaagccaaaacacgactttgacaccgcaaaccgaccggcggcaaagtcctcgctcgggtcttccgtatatcatggtcacgtgacaccaatatcccgggcccgccagctcccctctcagagcacttctgtgttcgtctcagatagagttcccgcgttctgccagatagtgtgatgaggtgggggaggtgggagagggggggggaatgcgggaagcatgattaattagcacagaacgaggatgggggggttgggtcagttgttggctatatagaaacttgatctgtttgtgtaacatgcatgcaagtgtgtatttcacctctttccgcgtgcgcgcaagaacgagagatgaggttgccagagcggtatctttgaaaatagataacagcaaactacagtaggcactttaccaacagcacctccaagacgcatatgggcgcatttgtatgtgagtttaatggggaaggattttttcaagacctgagcaaaagcggtattgaagaggaatatttggggcattcttagaatccctggaatcgaaaaaattagaggagtttggtaaacctcttttctattccatatcatgactttctactaagatgtgtctccccaaacatttcatcgccgcaagcatgcaacgttagataatatgtgaaaaaaagaggctaaaaaattgcggtgtttaaagtcgatcagaatatgtggttgctggtgtctaaatgtttggaaatacgatagggccgtgagaaaaagtacgaggtcacgcgaatgtcaggtccgcttcaaatacgctgtagacatggtgtctctcttgaccttctgtcttgaacagctgtgtctttaaccccacttcagataatgcgtgtgctcgaacggttttggtttatgtttcaggtagggtaacttgagtggggctttttttaggttgacgaatgaagattggatacgtttgtcaatgacagtatggagaggggaactggtcttgtgagcgggaggttgagtgtattccacttctcgtctcgtgggagcagtgtcttgtgttgttttctggtgggttcggagactgttgcgataacgcatgtctcgcatctattgcatgagtggggcatgatactattgggatgaatggttaagtaatttgtaactaatagtggtgtgttttgtcaatatcctattagaattgtacgagagtgccttgtgtgttataatatttgattatgacattgaatttataacattgaatttgatatcaatgaaaggaatgccctgttaagaagatgtgctcaatttactatcaatttgcttctgatagtgtcttccatacagactcatatcgttgatatcaagcgttgcttctacttggctgatgatgtaattcgctggaaccgactacgcacgcctaggagatcccggaacatttgtacatggtgttaatgttagtattggagtttcagtacaagtactgtattgtattgtatgtattgtatatactgtacttgtacttgcaccggttttcatcaactgttggtttctggtttcaaaatatactgttttacgacagctaattgaagggtttatagcccaaggctgcacggaaggtttctcgaagaatacctgctgttgctgtttccaggtgcaaaatcgaacacatcagtcgccgttacaagtgcaagtatttatacaataccattatttgcaattgaatcgtatttattctactgcttcaccccaggtgcatccatgattagatctcactactgccgaaccaacaccactccacacaaatctgctgtttcaaacaagaaaagcaggaaaaaacagtacaattcttttctagagagttaaaccagcaaattgacaaatcaactgtgtacaaaatacccaacaattcctctctcaagcgactgttctagacccgaaacagcaaccccccaaaatacacttcgatgttgggacaagtttggagaacgtggggaagtggaacattctagacactttgagaacacattgtagatcgaagagatgaagaaaaaggcgactaaaagtggtagttgtagaaacatattcggaccattcctgatatgtcacgtgatctctcacccccccccttcaacgcccttgttggcaccgtatcactatcactatccttgtctgcaatcatgcatgccctgtgcgcgccatcaaagtctactcctcaatatcacaatacctagacccactaaccatcagggtcattttttgttccgactagctagcctgcatcactgctaccacaatgccgaccgccgaggagtttaagacgatcggaaatgatttctacagcaatcacgactttgaagctgccattatggtgagtacgtctggcccagccagcagaagagccttgtcaacagatcatacaactaacacagaattattctcaagcgtgagtctgagcagggatgaatatatggtgataggtgacagacacggtctcacccaccctgactaacacagaatcgttaaaaacccgaaaaacgtcatatactaccaaaatgtgagttgcaacagacatatccgcgacagtttcgatccgagctaactcagagagcgatggcctactcaaagctaggcaagtacgaagagatggaaagagattgctcaaaggcattggaaatactgcccaactcggtcaaagcattgtactacctaggtatcgccttgacagctctgcgacggtttagacagggcgccgaggtactggataaagcatacgccgaatcggtaaagatgtcgagcgctctatcgcccaaaatctccgaacagattttgcttcttaaggaacaacgacactcccatgaactcgagtctgttcggcgccagtctgacacactgttgacttacatgctggagctgttggaaaaggataaacaggagcagttaaacgagctcaaagcacagggactaagtggacaggcactcagatcggaacgtcagtttgtacaggaggagttcttggataaagagaagcagatcatctccactttcaaggcctcccaaaagggatctcaaaacggaaactcagctatggaagagatccccgattacttggcggaccctatctcattcaatctgtttatggaccctgttgtgacacccgctggacagacttacgagcgaagctggctactagagcatttgaagggcggtggtaaagacccactgacacgaaagaacctcagccctaaggacctttatcccaacttggctgtcaaaaaggcagccgaggactttatgaagcgaaacggcaaatactaattaatgtatctacatatggaccatatgaatccacttgcacaacttgtagtctttctaccatgagcaaaaaggcagagccatgcacgaccaaaaaagactccgcaacggagaattgaactccggtcccccgcgtgctggtgtaatacctgacaggcggaaattctagccactaaactattgcggatttttcaatttattaaatattttactatatattcataatcctgcttagtcagcaacccctgaaaacccggcttactaggtatatagctgtaatgaatcattagaattaaaaaaaaaaaaaaaaaaatacttagcgtgatagtcaagagatatcaatgatatcactggaaagacttcctctaaaataataaaaaaacaactggggaatagaccaaaactgtgagcacgattgccgtccgctcttctgacgacccgaatccgagtatgacgtgcggattgtcccaagacgctccagtaaagtagctgaagtgtatctccctatgcttgaccgtgctccgccctctcaacgaggactcagtacggaacgctcgtcttccgcatgtcttaatgtatcgtgtgattatgtgattatgtgattatccataatattctctaaaaatccgagaattacatccgaattcgagcccaatgtacaattttctcgttgtatacgaaccacatatgtgtttaccgggaacaatcaagaactccagatcttgaatgtcgtcttggagggtgcttgtgacgagcttgggctgttacaaagcacgatgtcatttcgtttgtctgcttccagcaaataacagaaaacatgctaaagagggctcttctgaagatcaatttcacctgagtacctacaacgagcacacgctcctttcattatactgtagagtcatggcttgatctatcgtacaattgcttgcccaacacttgttggaattacctcacccaaaataacgcacaatccattatgagtcgcaatcatgacgcttgatataacatgtaacaacacgtccacgatcatgagtacacaagaacatggtatcaggtatacaacacgtctacttgtagaacttgtgctttgcattcgtagttcctggtcaaaatcatacatacattagctaactaaaagtaacttagatggctcgagaaaggtggaacttggggccagcgaagatggccttgtcaccgagctcctcctcgattcggagaagctggttgtacttggcgagtcgctcggatcgagagggagcaccagtcttgatctggccggctcggagaccgacggcgaggtcagcaatggtgacgtcctcagtctcaccggatcggtgggagaccatgacaccccacttggcgtcgtaggagtcgttggcggcctggatagactcggtgatggttccgatctggttgaccttgagcagaagggcgttagcggacttctcctcaatggctcgcttgattcggacggggttggtgacggtcagatcatcaccgacaatctggatgtcggtggtggagacaaagtgagaccaggcggcccagtcgtcctcagcgaaggggtcctcgaaagagacaatggggtacttcttgatgagctcagagtagtaagcggcaagctcctcaccggtcttccacagagacttgtcggaatcggggttcttgaagtcaagatcgtacttgttggcctcctcgttgtagaactcggaagaagcagcatcaatggcaatcttgatcttgccggtgtagccagcagcatcgatggcctcggtgatgaggttaagagcctcctcagcggtctgaatatcgggggcaacaccaccctcgtcaccgacgttgccggcggaggcaccgtactccttcttggcgagcttcttgagctcgtggtagacctcggttccggctcggagagactcggagaaggactcgaactcagtgggagcaatcatgaactcctggatggcgagtcggccaccggcgtgagagccaccgttcagaacgttgaggaagggaacgggcagaacgtagggctggggggagctagccagagaggcaatgtgctcgtagagagggacacccttctcaccggcaccggctcgggcagcggcgatggagacaccgaggatggcgttggcaccgagcttggacttgttctcggttccgtcgagctcaaggaggaacttgtcaaaggcagcctggtccttgacgtcgagcttggcgtcaataacggcgggggcaatgatctcgttgacgttctggacggccttgagaacaccctttcctccccacttggaggcgtccttgtctcggagctcgagagcctcgtggacaccggtggaggcgccggaggggacgatagctcggaagagaccgtgctgggtggtgaggtcaacctcaacggtggggtttcctgagttagtcttgcgattgcgtgattctttgcccttgttctttatgacgcagccattttttatttagcatcaaccgactggcctagcactgacgcaatgccatgtcatgcgtgtggagtgggtctatgcgcgatttcattggacaatgtttttccggaccccaacagagtttatccgggcggatgcgtcggtcttgagggggcccagcaccggtcaacaaaaagtgcacttcttggcacagaattgggcgagcaaaaagacgaattgtcgaattgcccgcccgcggtgtcgtgcgcgctgtatctgtgccaattcacctcttgcaatctccgcaattgcgtcgtgacttgactttgaatgacacgtacaacaagtgtggggaatcaacagtttgactgtgcgataatccaggcaattggcgttgtagttcgtttgtggtactcacctcgggagtcgtagacgtatcgggcgtggagcttctcaacaggcatggtgataaatgtgtggttagacgggtatactgagatacttgtgactttataactagtgggggattgctccttttatacatgatgcaaacccaattgcgctattggattggtcccaaatagtcatctgtacaaaggggggtgctttcgtcattcgaaagttaaaagccattgggggaggtgagatggatagttgaaggactgcaatgaaaagcatgttgcggtcccgtgacggcaaatccgactgcatggccacaataacctccccctcaatggcacaaatctcaaacttgctctcaaatacccccctccaccgcccaaatcaacagtctccaacacgacttccacaatcttctacgtgcgcttgtataccgtggtgacgcttagagttctggcaagtgaaaggttatgtccacgagggcaagggctggttgctgttcggggacttccatcccctctcccggtttattctcgtggcttttcgtcttgcaaatcggcacacacgtgattaccgatgggaccgaggaagactacatctacgcgccttctcgcccattaaaacctcctaaaccctgtgctccacgcccttgagctatttgtcaacgctgttggcgctaccgagctttattctgtagctaagtgtagcgtgatatgaccgcacacgcacggctatagagagctcagctgtctgggttgcactggactgcctacacgttaccggggaaacgccccgtgcatatccataccattaatctgatccacaaaacatgaacgtggatgctacatacaagtagccgcctgaaccaccgaatgtgtcttacctcgcaaacggcaaatcgggtgacaacatagtatcgaatgagcactcatcccatagttccacactctaaaatattaccgtagacgggtttcagtacatacaagcacatactcatgtttgcttggactgcaagtactatagccactacaagtagaaaggatgccaaagcctccacgcaccatggttgcgtgtgagacatgagctcaaagtgctgtatgtacgtacagaaccaacagtccgcccggtgatatatgcccggttgcctatccaagacatatcccgcagataacccaagtaatctgtcaacaagtcacatagagttttccagcggtactttgtggagaaaaaaacttgcccgagaaaactgggatcgactaaagagcccagattatgaccaatatacacgatctcaacatacaggggaaatttcagctgtataaaacacatattgaccactcttcaagaaacaagggccgaggtagatggaacctttaagacactgccctcgtaccaggtgaatctaacctgtctgagcaaagtgtgatacttttacaatcatcgtttatgcagttgcaattgctacgtttgccgcacacacaagaaatacacatgttgcttttcataaatattcaaggaatgaattagtatatacttccgggaagctggactctagctagctaatgcccatcatggtgttgtagaactcgtcattgtcgtgagcctggtcctgcgggaacatggaagaaagaacaaactggaaatatggatcatcctcctccttgacaacgctgatgcgcttgccgtcggagtcgcctccagcaatggtggcgtcatccatggtcggagtaaacatgggcgtggagtcgggcatcaccatggaaactgcagacatgctgtccaccgacgtgctgagactggtgaaactaccgcttccctggctctgtgagaacccgttggagttggtagtgtagacggacgagtcccgagaggcacctgcgatgctattcactccgaagctcatgctgttgccggcaccaccgttgctctgtcctccgtttccgttgcctccgcccacatcaaactccacaggattgccaaactgcatgggctggttatttgagtgcgatccattgttgttgatgctgttgttgttcatatgctgtccactctgtccattagtgcttgtagtctctagagcatgatcctcggcaatagggccgtagagagacgactggctgaaggagcgatctcggaattgcgacgacattggggtggcaggtccagggcccggtgtcatcatatggccggtaaatgcagagggcgaattcaatggtgtcacctctccgtcgtccagcgagaattgaggtgtgtgtggagtcatcaagtttggggtcacctggcctgaaccagagggtgtgtgcgacagcgagggcgtcatgatcgacgtcagcgacgtcactgagcccacctggcccgtcacatggttcatgggcatcgagttcttgcgcgcgtggccgggggccgacgcagtctccgagcctcgtcgcgacagagacatgttgttgcccataaacgagttgcttcggcgcattttggaagcggccgctagcgtctcggcaggcgtcttgcgctcgagaggaggccccagaaccgacgtggatgacgcccgcgagtggccgtggcccccggcaggcatggagatgcccataccgacaagggcagactggttagaggccgttgcgctggtgctggaccgtcggtcaaacgacgccgacgagttggaccggtgccgtttgggcgtatcagaattggttgtcgatgccagcgctggcagcgatgtggaggaaggatgcttggtgctgcctccgaggcccacgggggtcgtggggttctttggaggagctcccatgaccggggtggtcggtgtgtgtgtgttgttaatagaagattgagaagtggtagagaatgtgcgctggagagaaagaccgggccgttgtcgggtggtggtgggcacctgtttgccattggcgttggggatatgcataacgggtttcatgggcggattgttaatgttttggtccggctgggggccgtcgctgttgatggcggcggcggcagcagcagcagccatgtgtggttgtcgtactgcagacgacgggttgttggcactgttgctcgcactgctgttggcggcggcgttggccagctcgccctcccgctttttgatgttctgcttctccttggcccggcgattctggaaccagatctggatgttctttttcggcagatcaaggtcccgctccagctccgtgcgtgtcttgagacacggcttgggcgtctcgttgaacaccttttccagcactcgcagctggtgctcactgagcttcttccgtggcgcagggttgttggacacgggaatgtgcgacactctcacgccgttgtgctgcgacagcgctgcggctgcggcggctgctgctgcggagccaccgagaccccaggcgccccatggggtgggcgccgacaccatgttcatgttcacgttccagggctgtcggcgggcctgtgcggcagcgggctgctgctggggtgccatctgctgctgtggttgttgctgcatcgagggctgctgttgtggtgggccctgtcctggcacgggctgttgttgaggatgctgaagttgctgttgtggcgggtgctgctggtgctggagctgctgggtgacctgctgttgcagttgctgatgttggaacggcgactgctgatgcgacgacaacgccgtcatgctcatgggtggcgtgtgatgtaggctctcgctcgacgatatcgactgcgacgtcaggctcatttgcgacatgggcgtacccagctgtggtgacggcagtgtcgacgggtacatgatgtttgtgttggacgagttgacggaggcgttggcaggggtggggtttgagtacgccactccgctactgctgttgtgactacttccgccggggtggttgccttgcacgagtcccagcagatccacgtctaggtcctgaaagtcctcgatggactgcatctttgtgccaggcgacgggtcgttgggctggggggtcacctcgtgcaggtctccaaacagctcttcgtaggacgaggtgtcgtacttgagcgagtccatgtcgtggtggctctgggggccaaaccccgagtccatcgggaacttgtagtcgaacgttgccgtttgcttcatgggatgcggcactggcactgggaacgtggtgagtttgggtggtggagtggtgacaagtcttgtgataggagcgagtgtacaagatgaagagaaagagtttagacgttgaaccggcggataagtgttgtggggagtctgtgagtctgtccgtatgtgtcggggtcacagaaacagggtcgtggcgcggcaagtacgggaaatcacctatacctcgaaccaagaaccaaagccgggtgtacaaatactcaagacgaggtgtctctcactatcccgcactaaccctggccctcaaactcaaactagcgagcctgaaaccatagagataactttggtggcttttgggtgcgagcaacgaaggtggctggatggcactggtcgggctccgacacgggggactgtagaagccacacacaggatgacaagtgcccgggctgtcgacttttgctcctcacacgctcagcttcagaccgcccctcaaactagtcggtggtccagacctgcgtactactgatacaggcactacaagcagagttcgaaagcgtagtcggggtaactgtacttggactgtatggacgacaaagtacaacaagtcctcctagtgtccaaaataatcgagctataggcggtgggacagctctcccggcccagtagcgctacgtctgctcgtacgactaacttggaccactgacagttatcctgacacagaggctctctccccttgtattcaggtctctcaacccagagacccaaggtggtgccagaaaaggtgccagctgccagacgagactctaatccgactgtacagacgagacagggtaacaaaaatacagcaggccaacggcttgtaaaaaatccgatatttccgggcctcaaacagcccctgtgccagaccaaatcggggtccccccgcctttcgtatatccatcctcgtatatctctcgtcgacccaagatggaagtgccatgtggctactctaggtcgcactaaaaatgggtctaggctgaggggcagaaggctggcgtctagaaccgtgccgaaacctaaaccggaccatggaggcccattgtgagccgcaatagtcggcggaataaaaaaccgaaccccgtagaatgcttgttgcagcccggggaccacaatggtatattatttggagagaaaactgcgtcagacgagccgcccaatcgacaaaagtggtggctgttaaagccaagaaactgtacatattgtcccacccaaccagagttcctggccgacgttcatacaaggcagtttatgacaggaaaacagaggttttttatcgacaaaaaaaaaaagaaaagacgccgtcaatagacgcccaccatccaaggacatggggctgttgcacaggctacccgaacgcacggcagactgctgaagccgtgacagtcggtcgcaaaaagagtttccgagaaaggtttcttttagggagtgttgaaactttccatgcagaaatcctggcctacaggtacacaagtacagtactgtaactctgagacgacatttttgtttgatgagattcagttgctataaactctgcttaagtaagcggctggagatgtgacgggacgtctgacggagagcacgtggtcttgactctgtggtcacgtgacgcgccatatatatatatatatatatatatatatatattggatggggaggacaagtccgaggacctcctatttacattgactctagtcactgttgtatacaaggttgactccacttgtccatgtcgatcgtgactgtacctgcgccatacagtgcttagtaacggcctttgtttttcggcattatttagcgagtacgagattggatcggagcgagtgtgcgagtgccaggcgatcgtctgcagttagctctagtcccgaaggatgtctgtaggacatgacaactccgtggagcttagagcacgttttttttctgccactgtttatttttagcataatcatcgtgagtgagaatgccgtacggaggagggctacaagaaaggagagtaggggtttgggcagaaaaaagaaacgaaatggagacgaaacagcttgggatcgaaaacacatggcccgggcttcgggcttcaggacctgggggaactataactacctggctccaagcccatgacacaagtgaacgccacagcaaaccaaccaacgttgaaatgcacatgacccatatgtgcgataactgtatcagcggcaagtagcatgagtcgacgaggttttagcgcctggggaggtttttgggtcgaggttaacagtgcgttagtgtggcaggctttgaatatcaggtctacagatgaaggaggcagttgtgggtacaaacttgttgttcaacctggacaagcggagcggtggtggtaggtctaacctgtggtcggagactatatcaatggcttcggatatatctcgctagcagctcggcaaggacaaatacctattataacctagcagctcgtttcaaaaagccagcactaccactagtcagcagctacctggtactaactagttacaaacaccatgatacgtgacagttgctgttcagcttagcacatgttcgggttgtactgcaattgaccgtgatatttatagtatccgcctggtgtcatacctcacgatggttcaaaggagggttcatagcaacgcatcatcaaacgtcagctggaggccatgggcgttgctatgagggacttgcggaacaaggacagaaaatccatctaacgtgggcgcttggcaacacaaacagcatcacggtaccttcctagagaccagcaatagctcgttcagcctgtagcttggtcgagatctcgaaccagatctctttgtcaagcgagctactcacgtggaatattaacatggagcgtgcaagtcgtgcctacccggcgtatgctagtgggagtgaaaacttgtttgcctagccgcttctagaacaccgtgcatctattgacaaggtggcagtctcttgtcctcgaggaatacatctcattgtatctacaggggtgagaatcggtgtcggagattcgggactccgacgctttaaaactccgagagctggtgccgtgtagtttgaggccaaaacaaaagtcgttcacctgactacaagtagggacacagggagaacacgcggagtcgttaagcctttacaccgttgtattattgttgcaagtatcgtttcctgttatcataacaacttcctatagctggcgttcacggcttgggctgctaacttctagtgtgtggagggacttgcccgccttccttaatctcacgatggagagcgggaacactgctcaaacctccacgtggaaattgacactgctctaaaaaanangggggggggggggggggacttgaactgcccaaaagaaccgcctgcagctagcccataagcacaactagttgccatgtgtctggagacccaagagtcaaggcagcggaactgataggaatacgagaagagggttaaggaagagtgggactacaagtgagacactttttaaaatccccaaagtacagaagacttattctaatctgaagaacacactagtgaacaatggagtttagctacttgtactgtagatggttcgtcaggctcgtatagctacagtacatacagtacaagtccaaccgacaagcgcatgttaaacactccaattaggctgtgtctttatcggagttcttcttagctcgaaaagtcggtaacttcgctggattgtccactacttgaaagtgtcacaactaaccaagagtctggtcccgagggtagaggctttctccacgtgatagagcaattgggatacagtagcgagaaccccaattgtactatcaacttggaagatatgggacaactagtcgttgcaggtctacagccagtgatggtggctatcggtagtctgtaaaactcactaattgcatcttcggaatgtcgaccatctgactttaaaagttctgtaaatgaattgagactgacgtgaaagaagaggataattcgaaaaacaatacaaaaatcaaatctttacttatcgcagaagtgggtgctcgtaccagaaatgagtgctcgaaccagaagtgaagtgaatgcttgtaccagtcttatcaagtagtttactgatggccaacatgcagaagtgcatccgagacgggccaagtttgaagtgattgtgggcgaccagagctgagaaaaaaaaggtactgtgacatcaaaatgttctaaagtatcgaatgaatacttagtaataactcctacaataccaaatatccggtatattgccgattacgccttctcaaccgccctttatctggaaactctaaaggtacgacagtatgcacctgtttctgaaccacctaattacacttcccacaacacttcccacatctcacaccccaggaaatcacacacaacatgtccgacgacgatgagtttatgctgagcgcgggagacgaggattacgactttgagtacgaagatgaggaggaggaaatggaggacgacgacaatgaggccatggactgcgaaaacaagtactacaacgccaaggcggtcaaggaggacgagcccgaggaggcgattgagcagttccaagagatcatcaacgaccctgctgctggcgaatgggcgttcaagtccatcaagcaggttatcaagtgtctgacaagctcggatgccaaatcagcttctgaacgagaaaaaaagtggaccacaacgtttgaatactacggcaagatgctggatctcatcacaagcaaaacgacgtcaattacacgcaactatgccgagaaatcgctcaattctatggttgcaaacatcaccaagagcgctgagagtgagggatccgagtcctccgccagacagctggagaaggtacacaccatggccattgagcggctcgatgcaaacggctccgatggattgtggcttaagacaaagctcaagcttgctaagctttacatcgacgtggaggatcttacccgtgccaaaacggaaatttgggaacttcgagagaaactggatcagccagataccgcccaagatgcatccgacaactacatgttggagctgctttcgttgcagatccagtattacacccttgttggaaacacccgagaactaggcgtcatctaccaacagacgctcaacatcaaatcggcgtgtttgccccaccccagaattctgggagtcattcgagaatgtggcggcaaaatgtacatgcgggagaagcggtgggacaaggcatgcgaggagtttttccagagtttcaaaaactatgatgaggccggatctcctgccaaaatccagattctcaagtatctggtggttgcatccatcctgaccaactcagacattaacgtgtttgactcacaggaactacagccctacagaagtgatggccgcatctcccagatgatggctctgcatgacggtttctaccagtcggatatcagcgatttctacaaaaagatcttcctgcaaaagacagaccaggatctgcttaaagacaagttcttgaaacagtactttgaccagattgtcgatactgtccagcgaaagtacgtggctcacatcatcaagccattctgtgcactggacatttcattcttggctaggaaaacttccatcggcgaggaggagtgtcgaaagctcttggtgaacctgattgtggagagcaacgagggtggaaacgagagtctcagcgatgcaagattcaacaaactaaccggacatgtggttcttgatcctgccgtgcctcgccttgaggtacccactgtctctcaggctcaggatctcatcacatgtgaggcttcctctaccactggccagttgacacagattctgtacggaggaggagctggaggaatgatcgagtcctcttctgcttctgttaccgagggtcatcgagtcggtggaccccacgacatgcctctgtatgctggtgctgggcactctatgctagagaaggaggagaccaacaagggcgacatggatattccactgctctatcccgtgaaacccgccaagaccttcagaaacatgtctgctctggaacaggtctggaaccccgttggtcccatcaaatctagacagatggctacctttggccaggctgatttggatgaagacgatcttgataagcctgacatgccctattctcgagatgaggtgctcaagatctggactgaccgggttgtcagagtcgttgatgaggttactaatctgtagcctactgtatttaagaaattacgtggggtacttactcccttgtctgtagcacacatttattcctgtaacgatgcccaccagtcaaaccgatatattattcaatcaacaatggcaatattgacatgtgttgacatgttggcgaattctagaagtgagcaaacatcgttgctgttattccaaatccatccccgtcgctacttctgtggatttagcgactctcaaaaatatgagcttacataatcatcaacacatttatgtaaaagctgaagaaaggacagtaaaaaatgataaaaaacaattgcagcacctaggattctcgtatggtctcccactacaatactaactaggctctctggtgcttgactatggctgatcggacgggaagccgtattttcaccaggatatggccgcaactgacgcaataaatcactgaacactgttgtagggccagatgagccacgtgaccggaactagaatcgacaagacgtttatttattggcaagagagaagtgatgacggaatggaaatgtcataagacgctattactatatcattaacactgcttatctgacaaccaagcttggtgaccacttgtaactactggtagctacagcagtgtcgtttcaatcaagcaagcatggttttgctgcttggatactgttagaggctcctccatcttcgtcatggtccgccaggacacaggtccgggtatgtatagaatatacgcttgtggttcatttgagagttgaaaaagattcgccggtaggtgaaagaggttgtaaatatgcactcaaattgtgcgctcagtgttgtactaaagacttatttgcctcagccgtgttattattacgatagtgctaccactttgtacagtttcaactcatgtataccaacctgttagaataaataatgcaattacggatgaattccgttcttttcatcgtcggccgaggtggcctgggaagaagtggggggttgttccatggacgagttctggtcgtttggactggagccggccaggacgtcggcgttggcctcaatcgcgtcggcatcggtcgagtgctcaggctcatcgtgcatgtgcgacttggtggggggagtccaagccagccagtctcgtcggacctcgacgtagtcgtaggcgaactctccaatctggtcttcgtccattcctcgaagttcggcctcctcagatgctcgcagcttgcagccggggatgaagttgatggcgtagcagagcacgacagtcatgacaaaggtgtatccagaggcggccaacacaaaacaaatctgcttgtagatctgcttccagttgttggacacccatcctcctccgtgaggagtggatccatccaagccaatcacgtagtcggctccaaagaaggcgttgaaaatgagtccgacaattcctgcgacgccgtgctcagcaaaggtatccatggaatcatcaatcttgagaatgtacttgatttgtgtagaaaagttacaaatcgctgctgcaacgataccgagagggacagaggcccacagaggaatgataccagaacagggagtagcagcaaccagccccgaaataataccggaacagatggccacggtagaccacttcttttcgagccggaaatccagcagacaccaagtcagagcaccaaagcaggcggcaatgttggagttccacacagcgtagaccgccttcaggttggagccaagagcagagcctccgttgaatcccagccagccaaaccacagtagagcggttcccatggtcaccagagacacgttgtggggtcggaagttgagcagcagttgttcctttcttcggccaagagcaaaagagtatgccagacctccgataccagatgcaatttccacaggtcctcctcctgcaaagtccagcacgtcccagtgagctccagcccatccgttggggccccagatccagaatgcaatggggcagtagacaatggtggcccagcagaatgcaaaaatcatggcgggcagcagacgacctcgctcggccacacctcccaccacaatggccacggtcacagagcagaacataccctggaagccggcaaacagcagctcggggtacttgcgactgccgtcctcgtgtttgagaatgttcttaagaccaaagttgtccaggttgccgataaaccggttagaagaaggagaaaaggccaacgagtatccccagaagtaccactgaatctgggcaacaatggcgcccatgaaacacacccagatcatagacagcgccgactttcttcgggccagacccgagtacagaaaacccaggcctggaatcatgaccagaatcatgcacatggacacggtgatgtaggccacatctccagtatcgtaagtgtattgccacacatcacctcctcgcttctccagcatctccatcccctttccgacgatacctccgagttgttcgctccggcggtgttctaggtagtgcatcggttctttttgtagtaaattattgggtcgtagtaggttgtcttgttgttgttgttgttaataggactgctgttgtcttttggttgtatcgtagttagtgtataagccgttaggttagttgtgggaaaaaagtcttcaatgtcgccaaatgtacagtttttgtatcgttcacccagtgtgtacccaatatcccgcttccactcctgcgggaaccctctgctatttattggaacctgatcgccgaagcgtctattggtagccggtgggactctgattatacatgcagctaactctgcgagggaggataattttcacactctaaaaacgcaaagttggaggctatactgcatagggttgtgagtttattgggctccaaaagtcataaggacccacgctgtgagtcaccggggctgcgatttgtgggaatttcggtctggaaaataaacccgcggccttgtcctgaatatccagtttgcccgattaccccagttcctctcaaactgcctcagatgcgctcccgcctcatctcagatgaaccctgtgctgcaacgaagatagcaaatttgcacgtctaattggccagcgatatgtgcgagcaagttgttccaggtgacattcttggcgtccaagcccaaccagcttgccagtcacacgtgaagatgggtttctgggctgagtttgagaatttccatctcgaatatgacctaaaattgtaaattcttgtggaaaaccccccgttctaattctcattggtccttggctagtggctgatatcaaccgtcttttggctcaggctcggttaataagcagggtttgcttcaaccttctgagggatatctgtgcgaatttggggcatttactgaagctcacgaggtctcctgttgtgcttattaaccagcattttctcgcagatacccttaaatgtcccctggttttcgctccccttccatctcagcggacctgcgctggttggctatggggtggaagcccaccaccacctttattctcgaggcaactaaggtctcatagccgtatccaacaagtcgtgtgagtggaggccagccggtgtcaaaaaccaacaagccctggtcaccgagtcattatcattgttattctcattggtctctgtcatttccatgacccccttgtttgccacctcccctatttcagcccatatctccaccatatactctcatatcatctctctctggagaacctcacgcgccaagaagtattatgaaatatggaacaagcacccttcgtcgctacatgtatgcatctgcatcccaccagccaagccgcttatctccaacgctggtctgccattggtcaacgttgggccgaagtttatctacaacgaatcaaactcggcagagcaaatgccggaagaggttgttttggcttctcgaaacgggcacaccgcagagatccgggttttttcgggttctcgcctcaaccattcttcaaccgtctagttggcgctcttgtggggatgtacgtagactcacaggacccgtggaacccagtggttgcaaagctccagcgctccatctcccacccaatcctccccggtgcctgcccagggctcttttggcagcatggcacgtcataccactttgagaagttgcgttatcgttgttttccatgccctatgacaatcaccgccaagactgacaccgccacagtctgacacacccctctttgcctgacaagactcctccatcactttgtcattagatcttcaatctcgccagtggtcttggcaaaatcaaagacagactcgtataaaaaggccggaagactacggatcttcggaccagcgtaaaatatgtgagccggtgcaaatgagcaggacaatcggagcgaatcggcgcgccctggtcatcaagcgaagtctgcccagcccgtcgagaaaaaatggtatgagactgctggatccaagtaggggaccaccctccaacacaccaaacgagatgacgtcctcaccaaacgtaaacaacctccacctcatggatcttggtacgaaaagaggaaaagaggtacaagaacaacaatcgtgtggatgttacagtaccttgcacgtgctgcaagtgctacaagtccaagtcccacaggtgcaacggtagcatacgcgctcatgtcgacaaagaaataggtgcaaaatcttccattttgattcaaaagaaaagacaccttctgcttctctcaaactctctcgtgtgatccacaccctccacatgtccctcctaaaactgctccaccaacccctatagccacctctggattttttgcacatatggttcgagccttcaaccttgtttacgcaattaccatacctaaaatggggcctaaaaaaaaacaagaagacgcagagatgcacaacgagtctaaccaccgactacttgtagatagaaaaagttaatgtgcttagtcagtcggtccgagggagcaaggacaaccaggatttttcgtgccactcgtttcgctgaagaaaggttctcagaggtatctgaaatcttgcttcttggacttctgaagacatttttttggtcacgttatagtggtggcactatcagtgtttcagataacaaaaaaagctgaacatactgtaattggtgatatgcgaatcactatcaggccattgttaacgattgcagaggataagttctgataccatacaagtctacaagtacgactatccatcagtgaccgtgcctttcaatatgcgtgcctttccatattaaccgccttgtagtgtcgtttgcttctctttcgcccgaggtgccttgctttgttgttatttttttattctagggaatttttttgtctcctagggatattttttgtctcctagggatattttttgtctcactatctgttgggcaccctaccccggcttatcttgataagacgagtgtcaaggagtacttttttgttgatcttcgaatatcatcttctggacaatgcgctgcagtgacattgccgatctatctctgtgtatatgatagagaccataaaaaggctggtgaggggtatcacccgcaacaatgaattccatttacttaatggagcaacatacaatgttacagtgactctagtaaatatgatatctggttattactaagtgcttgttcaacaaaagtagtgcagttcaaaaacagtagtgcagttcaattggggcagcgtcgatcagaagtctcactggtgtgatcacctagaagacgccaattgacatacagatgattctcttttgctgataatcgcctagctgacttttccaccttctacatggttgtcctgaaacctgtctcttagctaaatatcttgggttcctcaacaatccaactatctgcatatttgacagccttataacatcgttaagttcctatatctgatctctactttcaattgaaaaaagttgctcactctaaagctctctcggcaggattcttttcgtttccccgttgtaaacctgctgcaagttcaactgtacctccagtagctacattctcgatggcggctttttgacttgtagaaaccgggtcaggttcaagggggtcaaaaaaaggaagagtcgagggatgtcaagctggtcaaaactgcgcagcctttgtttttcgacgcatcggcaaagaaatttcccttggggagaatagatatggtacttcaaaattacccactctgaacagtaaccagaaagaatggcagttgcagtctgcgtggagcactgaagagtacttttaacagtcgtctgcactgatattcaaattgtatcgatcaagaaaagttctccaaatctagcagcatatttaagtcggacaaaagaatgagactttcttggagtacactcgggactggatagaagtcttaacgatgctcaattgcgcaattgtagatacagtaagacccaatttcggtctttctcatgatggagagccaataaattgaaaaaacttgcatctctcttgcggttggaacatcatttgggtggtgactaaagagaatccgtgtccctgataacatgtgctgccagagcaagtacagaacaaatacatttgattgttaatgtcccattatatcaggttgtcacgactcggacgttaatattgtgtttctgaccggatttagtgtgttttgacaccatgttcctagctactacaagtaccactatcagaatatcgccccctaactacacgcaactgttggacctggcaggagaagccatcgagactgatatctatcaccattctcagagcacatctgattagttggatgaacagatgtactcttgactcgctacactacacaattggacaccaccccgaaccgtcacaatcgcatggaccgaaattgcgtgacaccgggattttggcaaccagcattgtttacgattgagtcgtttgagcggtgtgtgagaggaaaaacattgattgtttggttctgctggtggagtaaggaaactattggttacatgaaatacatccgaaacagtatcaaaatgaggttccagacaaccaatccaaacagcaattacttctcaaaaaacactaacgtcaagtaatatccaatgatattctacaataaaccaaagtccaccttgtcttttaccagttttatcccctaactattgtctattaaagcagggatgcacaccagagtccttgggcgcctctgtctactcttttccagtctagagcgaaaaataatataaaagagcgactctattgaatgggtacatagatatacacttgccacagcaaccctctctcggtgaagtggtatctatacaaccagaatggtggaagggaacacgatatacacccatgaaatcaccacaaggaagcagacaggcagaatatatgtttttttgtgttcccttctcatataatagaacttgtctccatcgacgaaagaatcaacgcagttctgggttgtggtaaggaagcgctagatacctatcaactcaccatcgaatgttggaattgcagttttgggagggaaatggctaggagttgtttctttgtagaaaagtgatgtcaatgacattatatttcaactactcctatgactttcctactttatcttctctatagcagtcttgtttggtgtcgccctgtatcacttgttatgtaaacgggcaattggacgggattgaggttgtgcacatgttatttttctacagttcaaaaactgaaagaagatagaatcttctcgagagtcatttcgagaaaatacttttattccgtgctatctgttgagttttgaagtctaccgctggtagaaagattcacgtcagagccagagtccagagccagagtcctgagccagattaatcccgagccagattaatttagaacctgagcaatcgagagccagagttgagtgtatctcgatatttgtacttatttttcaacgcactcggaattgcagacaaaatctttgacgtctcttacatctccagcggagatttcctgaatagaaatcaaacctctctcgcgtgaaagttggtcaatataggtggatctcatctctagatactctggctgaatctgagtgaaaaaaatactcacttaatagctacaagtagtgttgagttgaaaatcttctgtggtctcataacatgtaatgctcgcttctccatggtaacttttcttcttcacccgcaacttgagttcagctccgaaaaaaagaggttattagtaggtgtatagttgtcgccctaataactcatttgcgctcgtttttcagccgaacgctcacgaaatcgctatcccatttagagatgcgtattcctctttagttatgcattatcgtgcatgatgcatgtccgctgcaacgtcttttgacgtcatgtcccagatgacgatagaaccagactccgttcacactatgacgtaatatcgctcacatgaccgagcaggggacaaataacttggactcggaacgttgctgcttcaactagcccccttcgtgagtagcaactgccgacaaagacagatggtttcgccaccacccactggattgctggacttacgtcagccgtgtatccttgttgctttctataaataacgctggcagtcattgggcggtggaggtggcaacaaagactgccaggctttctagaatacgaagcgcaccgacacttgctgtgttaacctcaagaggacatgtagcgctgccaggcggaggctcccacttgtggagtatatcacgagaaacatcttgggctctggggaattaatacctcaggtttggtctgaatctgcaataaattttctggatttacaagtatcacccgacctgaatacgttcacggcaaattccgattttcgaaatctgtagattctgcttgagtgattttcggcgcatatcagctgattcgtgagtttggaacagacacaacttttttcgtagcccatgtttcttgtgaagacaccttagaacctgctaaacggcactatatggaaatagctcttgtcaattctcctttagttcaggcacagggagaaaatccgaaaaattataatgtcgagcatgacttgacactgctagagacagatgtttgacaggtacaattgaagggggaatcatgtccgagtctgtcatcattggcgaacatgttgaaaattgacacacttcattcaatgagctcccttcaactccctcttctcaagacctcaaaaattacatcacccagtttgaatacacatatcgtgaccatgattgatccaaattgtactgcacttgtagggttaagactgcagcaggctggtgcggaccaaccctcctctccgcgtggcagatttagcgcacagaatgccatctatatcccatgtccatgtgaccctggacccctgccaagagcctttgagcagtaatcatgccagtccctcaactctggaccagccttgtctcagccttatggtgtgtctcgtagtgcacatcttgtgagcgatttcaaactacggctaccgtcgccgcgttctcgtgctctcgtattctcgctagcgtaactgagcaccctggttctaaggcgtggtatattctcagtctggaatggacccaccatgtctgaaaccgcatccagctggggttgatgtgcacatgtctcaccacttgtctaggagttgagaatacaatataggctcgttcctaatggaatgtaattgatgattacacatcagctcacgagctaggtgacctcagaattggtcagcagttactttttctcacaccaaactatggtacctccgagaggtgtaagcgatggacatatggtccttcacagctgaagcagaaaaccactaagttcaaaaaacgatggattcggggccgggaattaaacaccagtggcgaacttgcctccctccctccatatgggcggtataatttttaccacccagctctaacaccaccttaacgctctcctgtatggaggttgagttagaaggcttcaaataccttgactgggtcgacgccttaccgaggcggagatcgctacggtttaatactactattttgggtcgtggggttattcctttgccaagaccgccaagcccgagcaaaaatgccaaggcatgggaggtgcatggtgcaacggctgtggttagaaccagcagcagcgtccactgtaacataagtcgcacggctataacgcctctgtatagcttgggaagccaggggaatgacccctttgggctatgcacacaccgcgtggatcctctggtcagcggcatgtgtaatgggctttagcaacccacactgagtttcaaacgtagtccttgtacttatgaaggtaaccgccagttggctcagacttttgccgagctctgggtcgaaaaaaaaacctcattgagacgtcgtaccagccgtggccttggtgctaagaatacgaccctaccaggttcggtccctagtgctgtactctagaaacgagtcttctctgcagcaacgagcgcaaaaaccttccaagttggtgatttatcatagggcttttcagtatggcatgcatttgttgccagtattccctgcggcagagtccctgttcgtctccctacgcgtacagtagttcccatgttctctcctagaatctcgcaagtctatctctaataataggacccagggttagcttggaaaacattttctcatttctatcaataacaaagaaataaccacgactagacatctgctttcgtatattccaaagtgagatggccagtgatagtcagtcacagccgagaggaagcgaaatactgtacacagctgcacatagccgagatgaaacccagatgtgaagggggtgggtggggggctgtaacctcccacataatacaacacataccgttaccgtaccagtacagatattttgatcaacctgtgtttcaatggaatgcacttctgtttctgtcacatttcgtaatcattaaccacttaactgggcaaggacttgtccttctcgggttatggatccaagacatcatcaacttccgtacttgtacctcgcacaaatatacacgtagctccacagagcgatacagtacgcatacaaaagacactctccaaaggcgaaacactcccccctttgcacccccacgatctcaagccccctatactcatccagccctagactctaatggtagccaagtcaggttcaaggttcactcttgagagatggtgggctggtgatagccaggaacaaaagttagaagagagagttgaacgtgtcttgtttacgcgttcaggtccactaaaaacgcgcattccccggaatttatacagtgttcagggtgtactgtatggtcaattccagtacatccactctacgtccccgggctggttcccttagagacgccaacacgttgcagccacttcaccaatcgctatcgtatgtacatgttctacaatcaccacatgacaataattaatccttatcctgtattatctatgcccaatccagtttcctgggtctatctaagtagacgttagtagagagataccactgagtagcggtggagcagacacgccggtctgctcaaatagtcatgcgcgtataaatatcatggccagcccacgccgggtgggtcgactgaggccatggtggagtttcaaactcgaggttgccgcatcccgtataatgcacaataaaataacaataataaatatcatcatctcatcacaactggtcaacgaatcgctgaacctctttggtgagatcgccaagacagtcatcggggtcgtcggcagcagagatggacacagaaagagcgcctcccttgactccgacggctccaaactgcaggaacgcacagttagcgccagtacattgagagaagcgcagtcgctcaatgttggtgccgcagggatccacggcacaaaggttggagatagagaaaagctccgaacgagcagctccctcagtgtgggattcaaagaagtccttgatagaggggacaaactggatcatgccaatgtcgtgcatggcggcaggacagtcgtcagggcgggacttggcaatgttctcgagcaccgacgatcggaaccctcgggcaatatcgaaaaactccttcgacttgtagtatcccttcttctgcacgtttttgggtgggggtaccaccgtctgcagctctgcatctccaaccatgcatcccaacgatgccagctgctcctttcggatgaactgacgcgcgttgtatgggatacgtgcgttggcccgcatcttggacgacgaaacggggtagtgtctgtagagagtgtccgaagaggcagacacgagcacggcaaaaagaacagccgacgcagacacttcgttcttatggcacgtgtcgagcagacgcttggtcttggctttgtcaatgtcgatgagcgagtatcgtccagtccacttcttcttgtgtttgggaccggttccaaatcggtactggtccacctccttcgagtagaccagtcgacgcagagccgtggcaaaggtgcacagcggcttggcgtattcctccatgagagcgacgcagagcttccagtagggcacggagacgttcatctggccctccaggggtggtgggatgggagctccagacacaagggccacgtcatgtcgtgacacggacgggtttcggacattctgacatgccttggcgagcttgacgcagacagaggctccggacatgccatccaggggcgtatggtcgtagacgaagacaagctccttgcccttgttgatggggaagactctccaaaggggcttatcaccttgcagatcaaactgaatgtcgtggagttgggtgtggatgttggcgatgttttcttcgttgaagtactcaagagacacggcgtcggatattctgatgcccttgagtttggtgaagcgcaggtctttttcctttcgtccagtgaccacgacaccgagcatgggttcgtccatgatcacgtcggccacggcctggtagagtacgttcagttccacaggctcatcgagctctgcagagacccagacgtttgtgtagagcccgagctgggctctcaccgccatgagtcgttctaggggtcctgtagttagtattgtagttgcaagtgtggtccaccacaccaccacattccacattccgcagtggcatgttggtgttgtaccgtgtctacttgtgggcgtgatttacgtcggttctctcgcgttggcagccgcgggagtctgtctgccatcttcgaccacgccttctccaccacctcgccatctaccgccactcaccaagttgtcgagacatgttgtcgcacatctcacgttccatatcgtcccttttgtacaaaaaataagctcttgggaatatataatcggagttggcagtgtaggaggggcaaaaaggataactgcaaagtttgattgaaagagcaaaaggaaaatgaacaaacgagctgaacacaaacggccagaaagttggccatgtactggtggaaaaatgtcatgatcgtgaaacggggatgaagatgtttttaatctccaccattttgtgatttttttaccaagtcgggactcgaaggcaaagacgaaaacacgtgggggtcggggataaccaaactggtgatgtcaccacctgcgtaccaccactacgccatggtctgcaagaacccacgtttttcttcaagtaataatagcagcataatcgacatgtgaaacgacccacctgcaacaacgtccacgctgttttgtttaggggataacaaaggagtgcatagagtttcgtctactctttgtcccgagacttggctctttttagagtatccgtccttgtcacttgactcctcccaaatgtagtgtcgtcaacatgtcacttgcacccaacctgtgattctaggtagccgtgcccgaggcccacactagcagcccgcccccgtccttttacggccaacattcgcccttctacggggcttttaggaccgcgccctggtttcttcagcccccagagtccttgcaaagttccatttcgctagacatacacctggggtgcgagattcagcctctgagccggtgccaagaatggtaatacgggggcttttcaaaaagcaagaaactgcaaaaagcaacgtaaaaggggccagctcgttttagacattcaacatacacgcgtcttgtcccagctaaattccccctgccccctttccaaatttcccagcacgcgtttggcgtcaaatctcttgccgaccgcccgaatcataactcacatagtaacaaactctagcatgctgccgacctgtcggcaaaagacagttgccgtccacgaagacaacaacagatccccaaagtcgaggcctccttgcacaaccccttacagcaactccaaagtaacgcacagttgcagagatttttttttttattcggcgtgacacatttgttccccacatgctcctccttgtccttcttctattgttccatcttgaacatacccttgtacacgtgcagcctgcattattgtacagcctacctgtcccgaaagaagacgttggcagtgcgcgtaccgcttgagatggtttctacagcgctcacactgtaaggtggcccacatgtttttttcgtctgcttgctgttttgcctttcattctatgtccatgtctccccagatccaaatggactttttgctatattgcacggcgtgcaaattccctcaagtgtggtcttgttttagtccgttgcgttttttgatttcccttagaaattcggtttgtcctccactgaattagaagtacacgcttgaaacctggaatgcgagccggggtgcaacaaacaggaacggaacttcccatgtatgtcctttctccgtgacgcctacgcacggtcacattgtacaatggacagaccaacgaggatgaagatgagtgtcgaatacgggagaacatgaaacagactcataacaagtaggagcactcctcccactgtacttgtactgtacataccgagccacatgaacctcaacctcaagctcgcactcgtgtttggacagatccgctttgggaaaacatgtcggagtcatcggagacttggctctgtctttggctcgagatgtacgactcgctatccggcgtaacagatgcatatctaaaaatggcgcacggggctggatcaactgctttgattcgggcatacatgtccgctcaattaatactcatgccacagggcagtgtgaaaacctcgtacccaaatcccgcgccaccaaccaaactatccatctcctggacgcctgaaacacattccaatggagtccgcacctaggaacacccctttcttttgggctccccacattcttggcactcagccctgcctctcttaggctgccaagaacaccagccttgcatatcccgggaataactgctggctaccaacctactttgtcagtctggatcttcatctgggctcataatcttgttcgatggctggagtctccaaccctacagtcatgtgaatacaacacgagaccctggaggagttcaccgagaaccacttctaaaaataacaggaccagagaagaccagcttgcatcctagcgtgcacgacgcacacagcctcgtgctgccgctggagaacacaccaccactgcaccacttttctagattctgctacggtgctacccggaccatcgccccccttgttctaaggcttcgaaacatgtttgtaagacaaggcaggggtggatctatacagcaatacggcatgtagctaagccgtgaacggtaacatactccatatcatcgagtatctataatgactacgatttttcattatacctcgcttcccaaggtactgaaaactatacagtggcatttacatcgcttacaagtgtcaacagtgcggcaaatcaactaatagcagtacatccaatacttgtaggctactcttaatacaacgggtaacgctcataaccgaattacatgctgtattgaatctttcgataatgagagtgtgtacttttccgactcattaggagcgacccaaacacgaatttcttatcaacacagagcacaaccgaggttccactaatttcgcacttgtaataacagttcaaacacattcaggcgaacccccctggaatttccactctattgtccacatcccaccatcaaacatcaaatcaattcatttagtatacattaaaaaatatccatcacattagtgaaattcttctcacctcgctccttccagtaatctccattgtacttgtagtaagtctcgccagtgacagggtgcttggcttcctcaaaaaatcgaggcttgtacacctcacccttagcctcccgctctcgtcgtgcggctcgctgcttctcctcgactcggttcttttccgttgcagcatcgtcgtatcgagcctcttccatggctcgctgatctggtcgaagacgagtatcggtcggtgctaaccatggcttgagacgatcgggaagagcattcagagtgatagcaaaaggcgtaaggttgaaaggcgcaggaggtcggggattgacctcccaaatgacctccttagactcggaaccatgcttcttgagatagaacttttcgtgccagtgtcctccaacggtccactgagggttgccgttcttgtccacaacgttacccttgacctcgaaggcgccggctcctcgccatcctcgagccttgaaatgaagagtacaggtgtcaccagtgtcgtggttagtgatggtcatatcaccatagttgtcgacgacaggagatccggtaataataccgacaacttgggtgttgaccttcttccatgtgtacaactccgggggagcgttatcaggtcgcaggttgaggaacagagtaccaagagggttgatatcgaaagctcgaccggtgaacttggacttgacattactctcacccatgtagtcccagtaaggggactcagcatggcaagcaccgataggaggatgatgcgaaacctgctcactgaagaatcggaacttcttgtcgggtcgagcgtactcgtaagtctcaccaagaagagggttgaagggcttcgcaactcgaagagtggtggaagcgtactcggaagcagcaaaggcagcaacgtaagccagtcgcttggtggagtcgtcgaaagttcgagctttgtccagcagatcagtatactccatatcctcagcgactcgctgaagaagagaagaacactcgttaaaagacacaggcagagtcatcttggtcatatccttaccaaccaggttcttgagaataccccaaagggacaccttgggtcgattatcagcagaaatagcgagctgctttcgaggggggtcctcgtaaccagcaaaggagttctcgtcaagaatctcctcccacttctccttctgatcctcgacctcaagcttcacctcgccaacaccaaagggcagagaaatgtccttcttgggagcagacttgggctgcgcacttttctgctggggttgagactgaggttgagactgggccttgggctgggactgggactgagacagggggagggactgctgagactgcgaacgagaaccagcagcagcgccggcaccaagagcaccagctccgacagctccagcagcagctccagcagcagctcctccaacaccatgaccagaatgggcctgggggataggaggtcgctggccctggggagcctgcgtaggctgaccctgaggaacgggaggggcttgggcttgaggagcctgaccctggggagcctgggaataagattgagactgtggcacaggaggagcctgtccttgagggccctggtgggcctgggggtgggattggggttggccctggggcacaggaggggcctgtccatatggtggaccgtgttgaccatgctgctgctgaccgtactgctgctgctgaccgtactgctgctgctgaccgtactgctgttgtccctgctgaccatgctggtctcgggaatgaggtcgctcatggctggcaacggaacggacggactggggtcgactatcctgtctcacggactgaggtcggcttccctcaccgtagtgagaagagctctgagagtagtgagagtctcttgaaggaggagcggcaaacgaatctcgagaaggagtggcagcgtggccgggctggttgtgcagaggaggctgggacagaggctggtgggacttgtgggcctgggaggcagtcacagcggcagcctgagcagggttctgggaatggccgtgggtctggttgggctggacatgctgaccgtgctgctgctgaccgtgctgctgctgaccgtgctgctgctgaccgtgctgctgctgaccgtgaggaaatcgttgagactggccgggctgcaactgtccgggctgactacccatgaaagaagtatgctcagtgtaaggagtctgggcaagaggagaggggtcgttgatagacttggcaggctgggcaggctgagctcgagcaccatcgttgacggcctcgtaggcatcggcctgtgcgacagcaataccaaagggattctgagcaggagtgtgcgctgccgaagcagcgtgagatgcagcagggccaggatcgaatcgggacttgggaacagcaggagctgcggggggagcagagttaggagcagcagatcgagaaacagctccaccagcaaggccgccaactgcagcgcctcgaacaccgggaccagcggatgactgagactcctcaaagtcgaagccgggctcctggatctcaggaatgtcctgagtatcatctgcatcaaagaactcatcatcagaatcgtcagaaaactcgggggcttcggggaagggaggggaagcaaagccagcggcaactccgtgaaggttgtgcatggaagggtcaggagacatagcgccagaaagagagtttcgctggtacgaagtgtaggcttctcgcagacttcgtcgagccttcttcttctgttgggtggcctcgtgcagctctcgctggatcttctcgtgctccttctccaggctctggacattctgctcccagagatgctgaatgtcaatctctcgggccaaacgtcgctggtagtacacctctcgggtctgagtcattccggtgtactcttggtggagcctctcaagctgtgaaactccgtcctctagagccttaaggccaaggccgaggtttcgaggattcagctcgcccttgtcgttggactgaaggagaatagtcagagcgtttcggatcatcttaaactccagaccaatagatcggcccatgaaagcgtagtcagcgtcgtttggagctcccatctgtgcgagatcctcagcgtcgttggtgtcatcgtcatcgtcagaagcatactcctcaagatcgacctcttcatcgggagcacctgaagaggaggcagctcgagatcgcacagaagcagatccagtaacaacgtcagaaggagacagctggttgttactgtaggcagaaatgggtcgttcggaagcagcagcggggatggcggggggagggcctgaaggaggaggcagattgttaccactggtagcggcagtaataccgccggcagcggcaccagcggcagctccgtgagaagctccgccactgggaatggcattgccagcgcctcctgtgttagcgcctcctgcagctccacctgctgtagcagctgatcttgttttcttcttgctgccaccttcctggtccttggcccatctgatggcgttgctaatgttccaaacccacttgttggtctcaacgtgatgcttggccttgaggtggaacttatagccgccctggacctttgagccaacctcgaacttgagatcttcgctcttgtcgagccgtacgtaggcgttcttcatgttgatagagcctcgacaagtgtcggtgctgtcctgcttcttgtagtaggacaaaacaccatcctcaagcacaaaccaacgcagcttgtatccagaagtgaagttggtccactttttgaggaaacccttcatctgaggagcggggttggactgcttggggggtccgttggcgatatcagcctcggaaatgacttgctgcttggcagtagacttttggagcaactgtcgaatggtttcgtccttggtcagatctgaggggagctggccattcttgtttcgaacaagagggtcacctccgtgcgataagatgaactcgaccattcgagcatctcgtctgtgtgcaaagtcgtggaggacggtggatccagtctcggggttgtggccattaatgtcgagaagagacgacgatctggggttggtcaacagagcgtcaattccctgaagatcgccacggtcgaacgccaccttcatctcgttggagatcttttccacaaacttgtttcgctccgtctgaatcgtctctgcaatctcggggtatcgggcaacctccatgggctgtcgtcccagcgagtccacgagggtatcgtcgatctcgggctgctgcagcagaaacaggaccacctcgtctcggccctgctcagcggctagatgcaggggggtcttgttgtagatagtgtcctcatcggaaggcgcagtctgtgcgttgacatcaatatcggggtacttctggagcagaaacttgaccacctcgaggtcagatacctgcacggcaatgtcgagcagatcgtttcgaagctccgtgttggcgtggggaccctcggcaatagcctggattcgctccagatcgttggatcggagggtggacacaatcttcagtcgagcaatagatcgctccacattgttgtctgtgttagagaggggtaaagagtgaaggaaggtacaaagacggacagttgcacaaacaggcaagttgcgctttcaccaggtgtcggaacgagattccaatggggtatctgtgcatcctggatactttgaatatcacagcgtgagatagtgggctgttggtgtgatgaaccacatgcagaatactaaattactgtaatggtccaactaaggtgatgtcgggtggggatgtccgatggtggctggcaattcaattgctgtcgtttcggtttctcatttgcgccagtatggtaacttcttcatctctgtcaatcattcaatgtcgtggtctttgttgcccgtgtcgtccgtgtcgtccgtgtggttgtaatgaccttgtcttgtccatgtagtcgtccgtgtctgtgtcgtctcctatctcatttactcactctgaacttgcaaggtaggctcggaaagaggctgttgctgggttgtggacggggtatggtgattcgcagactgaggctggcgctgctcctggtacgaagctggcactggtggcgcctgggtctggatctgggaattgggctgtcgggaagcccggggatccagcgttttgggctgtgacatggcgggggtggtgatggctatccagaaggaagagtcgctcggtcggggtcctcaggtacaaagtgacgtggaagagaacgcgtttctttacccttcactaagattgctaaaaccgctctgagttatagacatttggacactcctccaacgtgcaccacacatgcaccaccataaagaaaaggcaattttaagctctgcgccggcgtgtatggtgtcctcccaagtcagcagctttttttgctccatgttattttccggacatgtgcggcattttccacaggggcgcttactaagccttttttcgcgccccgcatcgttcccgacgtgtgcaattgctctcaacattatatctcgcggtccaaccctgccgctcgcagccctacaccccgggttgtgcacgccttacactaactccatgtgatccttctccaatatttccaatagactttggcgcacatgcttcctccccgacctacacacagcacagttacgagccgacccgagtgtttgtagtgatatatagaggatccggggctggatcaaggggcgttagattgaagtttgtgctgagatgtgattttcttggtaaaacgggtgttcaattcttggggaaagctgttcttgttagttccttgctcacctcgataattccaccattgctactgtctcatatcgggctggtaaagctttggagttgagcagtatccacatgtgtgtgtgaaaatggaggagtttcagtttccgatccagtccgccatccacccagttgcccggcttcgttctcttcgcggaggctggggagtgtttggcacgtgaatgaccttaaccagctcacaattacctctttccctgcccctgcctagactcctcatgtatatggtctccctgcatggagagctctgacactgccaaagatacgacgatccttcacctgccagattgcgaaaaggagctaagagaacatgacacatgtgatactggcggaaatgtggcccccgaagcatgaaaccatcaagccccctttaagcacacacacacacacacacacacacacacaattggtgagtattgctggtgttccatctaaaacgtatgtgccgattacatgtgacttgaaggctatgaccatctagctctgggtttagctactcggttgtagatgacgtaatctagcgggtcgcgtacgacactaaacatggaccagggtgctacagtacgtccgaaaaggagacgaccggggggtggggggccacttctgggctggggtcacgtgaccccctttttcggcgcctatcttcagcactgcgttccccaccgcacctctgttaggtagaccccacttcgaaacggggctgtgcaatgtcaaaagtgtcttggatgcacgctacagctgaggacactgtgaatgtggaaagccggaaattgaagatgacgttgaaaaccagcgttaattgaatcagcaaaaagaaacgtgagaagctggctactccgaaagtgatgatccgcagtctgggacgagtgcaagtagcggttgttgactacacgtcctcctctgttatatttcgaaacagcagtttaattgaaacagcatctcgattggaacagcagctcaattgcacgctcaattaccttgtttacaattctcgtcaatttttttttcttgctctacccgattcttccacacgttgttccatacctccacccaatcacattgccttcaaaaccaaactctacagttgacctactttgtagttgacgcgtctcttcagactcgcagccataagatttccgctttggtgcgggaatgtcgttgaaatctgaaggacactgttggacaagaatggaggcacccttgcgtttgaagatctgaggtcatgtgacagtatatcttgccaaaacaggtatacgatttctgtagccgcttttttttctgcattacaaccaactattttggtcgttgaagtagttccagttagcgtctttaacagagtactacgtgacggccggacttccaataacagaaagaaagaaagaagaaaaaaagaagaagaaagaaagaagaaaaaaagaagaaaaaagaaataagaagaaaaagaagaaaaaagaaataagaagaaaaaaggtggggggggggggggggggggaacacgtactggtacaagtatgatacgagtagtagatgctgtacaacagaaaacagacaagacttcgagggattgtggtaagaatcgtctttatacaattgattaaccttacaaaatgtttctgacaagacaatgacaaataaaatacttttagctacccacaatatgagctacattctacagtacatccataggacttccacctggtgggcttgtaccactccagctcacctagtaataatgtaattagttagaacttcctcccgcctgctcctactccatcaaataccaccattcgtggttctgggtgcaaccattctcacaggcaaacgcaatcggatccaccttgtctccaaacaaaatgtaaagagctacggccacgttcatgatacgttctgggccatgcggtagagtccatagactgggaatgtctgctttttgaagtttggtactcaactgctcttcctcgtccttctctctgcttcctgaaaggtgttcgtgggcctggtagacctgacgaagcacattctcatgttcaatgtactttttggccttgagttgcagctccgactctgttgtggaaaactgttgtagcggcttgccagtctcgtaggcctcgcagtatactgcaaacagacattgcaagctggtcagctcatcgttttccatttcatgctccggtttgtatggctagacacacagagacggccacggtggacttataaacaccggttagcgtcatgcggctggaatgaggggctgaaaaccatcaacgtccgaacctgctgaatcgacccatgccaagtccttacgtcatcatggcccaccgatgctacatgccaagagcgctatagggcgcatcttgacatatggcaagtgctagtggatataatgagggaaaaaattacgcacccccgggcacccaggccccgtgcgtaggtaacagacggcgtcatatccgatcttgcaacctccgaacccataatataaacagagtcatgggtctcacttgtccttaccctgtgcagtctaaaaccacactaactagtgctagttcatcacctacagtattgttgaatgtgagccattgggagatacgaacgctcttagtgtcttcgttcatagtcttaatggcattggtgttatgagcagtcgctggttattgcactactgtactcctacttgtagctatgaggtttcagaggaggttttgtgtgcttctagatccaagcgctagtctccaaccaccaccagtcgatgagcccacatgtcaatcatagaggtcagacaaggtctcgtattatcgatttaagcagccaattgaactatcttctgggcacacgacgaatcaaactccgaggcttcttttttcttacactggggaatcagtaggagcttggactatggtaccatagtacatctggtaactagttacacggcagtcacgtacagtactcgtacaatatgtactgtaggcagcatttatcaaaatctgaatgcactaaaaattgcctttataatcatcacgcatcagaatcgaacaacttggtcttcatgacccgcagttcgaaccccataaacaccttgatcaccgaccagaaagaaacttttttcgactgctgtgaaaaatcacctccagatcacatcaccacataaacaccatgaacctgcgaacgtgtatcagtggcgtgcgacacctgtcgacctcgcgggccgtgtgcaacgcccccaagcctgggctggagaactatgcccgagtggtcgactccatcaagaacgaccggcagaaggcaggtgacgaaaagcccaagaagaagctcaatctgcgaaagaagagcgtctctgaagagtcttacgcccctggaatgggccgagtgactgtgggaggatctgccgatggcaataccaacaagcgggtcgatcgccgaatcaagtttggcaactcctccgccatcaacgacaacctggtctccaccaactacgatgctgccaaagacaagttccgaaagcgacgaactcccctcgacaagaaggtggtccccaagcgatacggagaatacaaggccgatgaggaccgaaaggctccccgaaagctcttcaagaataacagagagtccaagcctgatgtctccaagagagatgctgaggacgagttgctgaccgattacgtgactgttgctgagaacgcccgtctgcaggctgctctcgacgcccttgatttcgagaataaggatgtttcaaaggctttcgctaccctcatcacctccgaggcccagcccaagactaagaagattgacaccgccaagctgtttaaggacgcctttgatccgtccaagggctccacctttaacacaggagtggccaagcccgcaaaggccgacaacgccgactttgtcgtccacaacctcaacaagaacttctcgttgaacgccgagcaagccaacactcttctggacattgtgtccgggaaaacccccattgcctctctcaagatgaaggaggagaactagtatgtatatagtatgtgatgaatgaaagaggaaacgcacagacgtgtctaagcgttccgccctagtagaacagcccgagcgatgcacttgcaacattttcatagacaaacacaaccaccagccgtacgagagtatttggtgttatactggtagattcattcaaatcattaatcattattttacatattactgatatgctgatgttccatccctcctactcccttctaacctcggcatcaattcttgtcaacgcagtcagctcgttggtcatgctgacattttcacttcgagtcaaactcttcatcatcagactcttgttcttgtcattggtcagctgtcgcaaaacattcttcaagtacccattcagaatctcaatgggccagtttggaggcaccgcgttgagcacaaacttggtttcaagatggttgccgtacttctccatgacgtgacgacagtagtacacttttgtatcctggtcagacgtgatcttgagaagctgcttgaacaagtgagtaaaaagagaccgtttgagaatctcatccgcagcaggtgtacttccctccacattgtcaacattggcacaatagtcgaccgcagtctgatagtcagtgagatcgtgcaccagcatatcaatgcatctctgatggtcacccaactggccataaataatgaccaactccaacaagaactggttttgatagggaatgagcttctcttgaaaactaagatagtcttcgagagtcaaggacgacgaccaattaacatcaaaatgccacttggcgtccccgaatacaccttttccacgagattttttgccattgtgagacttgtcatcgcccttctccttcttctctccacacagtccccggtcaatcattcgaatgatctcaacacggctggccaaggtggtgtcggtgcccttcttcgacttgaggaactcaaagtacgaccgcttaggggggttgagagccctgtacgctgctgacacctcatcctcgtcgtagtccttggcatctttgatgtcagcaatgcactcgtcaatcagtaaaccaacatactccccaaccatactgacctcaccctctacgaataacatctgttgaaggtaagatttccaagccacctggttctgcatggccttgatggcggtcgagatcttgtccttgtcctccttggagttaaacttgattttcgagcctgcattcgaactgtcctggtccacaaaaatcgccacgccttcctgaggaaacttgtcgacaagccagagtccataagcacgcaccaactctttgtctgagcatgtcttgagcagcgcagaaaggcgcttggggccattggtgaataagggctcctcaatgtcaccggcaagaattgactgccagatttcacagacagaggcaattttgttgacacggagatcgagcagcgaaagtgggtaccacttcttgtgctccctgagaatctccgcagactcagaaatgcccttgtcggtcaccagctggctctcaacaagatgcatgatagcacctgtgacaacatcagacgaatcttcggccgtattctcctttaacaggtcgctggcacaatcggaaaccagcaactggcacaggagtacctctagcatccatctacccttgaaatcagcagtgttggggtctcgcagatggtactggcagatatcgtaacaagtatgccaccattttcgtgaaacaacgtccccagacttgtcatctggagccaccatgcttttggacacatcaagagcagtaaccacaccattgggtacctccaacttgtccaaaatcttgggacagaaaatgtacatgagaatcttcagatccaacaggtaatcgtggaaagagttggtccatatttgcttgaagtcagcctgtctgtcatgagacaagtgcgacaaacataccaagagttgcagatactctttttggcggttggcggcctctgaattggcattatctccatgtccgaacgattccaattcgatatagagctctcccagcttttgctgctcgactagattctccagatgaaacagtcgaggggtggagatgtatgtgaagactcctttgtcagagtaagtaaagatgtttgaagatgttttgcaccaagaagagagtttggtagagtgagaagactcttctatgtccttaatgtcatccttcgagccacctttgtccttggcgtagacatccaccagtgtcaacttgttcaccatctctgggaacggaatatcgaactgtttgagcaccttggagatggttaccttggtggcaggttccacggtggcctcggtattttccttcgaagccccttctggctttttagcttcttccccggcttcattatcggtccccttatcctcgccctcttcagattcaccctcggcatcttccatgtcctttttgtccttcttgtcccccttgtccttgtttccattatcaccgtcggtattgctatccttcttgcattcctgcttgtcgtcagacttctcctctttgctgaccttatcatccacttcatcgccaatcaagacctctgtctgattgacgacattatggaaacacactttttgaccaacaaccgcgccaacaagaggataatcgacaaccaccgaggtaggataatcgttccacgcaatggtaccccgcgaaatgtctccatcactgttgatgatcatacccatggcaggatctcccttctgagttccacatgcaactagaaactcggaatctccgacaagggctgcgacgggctgcggcttgagatctgctccgctgtcggcaccactccacacctcaaacaagggcacttttcgtactctctcaacgtccacaagatcatatgtcttggtattaccaacgagacaaagacggcctcgacgcactcctgtgagagcctctgcatagctcacgtccttgacgagcttcaggccgtttgcagacacattgacgattcgtatagtgtttttcgtgaatgtagtgacgtggacagaagatgccgctgccgtggggtttttgagaagagctttggtgatgtcttgatctacacacatgtccagaacatctctgaccttgccaaagccggaggcaggagcgaactctggcactgagaacacggagacagtggaattggacagaaccaaagctctggagatctggggaagtaccacaatcttgtcgacggtcctggttcgggtagcatgcaccttttgcctgctggcaatgatgtactgtggtggtgcaatttcacgtcccctgtcggtagaagagacctcaatgtcctgaacacagaagaagtgcagaacttctccatcagaagtacctagatagagagagttttctgtgttagaagacggaaatgattggaatttaactgtactcatccatcgtaggaaatgtgtgataccccgcagggaaccgagcagcactcgacacccatgtcagcagtcactttggactatggaaagacacgtggaaggtaccgcaaacatgaatgtgtttgtgtcgtttgatttcggagtttgaaagaatcgtcttcgcctcactgaagtgtgtgatcccattgccgatatgctgacattcttcctctctctctcatactcaccccatgcttcaatgcaggtaatggtggcgccctccagcacgtctggagccagcgtctgcaccttgagatacggcggtgtttccatcgaggccttgttttgaagggtcgcggcgacgtgatgtgctgtctgtagcaggtcaactggaagtgtgttttgttgaaccgacgagatagggttgcaggtcatgcagactactccgcgtcttcatcaggattacaaccagcagtctaaaatcagcacgagactgcaactaaacgaccgcggaaatgagcatatcgtataccggccagctgcccacgaccagcccgttgtcgctgactcaactcatcacctcagaccgataccagcaggttattgagaatgccgatgctgcccgggcccgagtgagagaacagctcaaacacgccaaaaagacaggcgccacagaggcgaatggcgacattatgcctgtgatcaaggctctggaggaatatatgccacacattaccagcattgtcgacaacgaaggggtgtttcgattcacgtctcagatcatcacttgctggagacttccgttccagtcacagtcgtcaatggccaacaagacgcctctgcatggtctcagcttcgaatatatcatggtactattcacgtacgctctggctctggctaccttggccaaccagtacgtggctagagataaggaggatcgatggaagcatgccagtgcatacattagtaaagctcgaggcgtggtagactatctcaggcagtgtcgaagcttccagatcatctgcaacgaacctccagcctcggtccctcgagacctcagctcagctacaatgtcggccctttcacacatgctctgtggagcgtcccacatgctcattctgtacaagtgtgatgcagagacctatctggatggaggagctccgtctgcaggcgcaaactcgggagggttttcaagctcgttgttacttcgaactgcaatctttgccagagatcagtttgaaaccgcttctgccctgctgggagaaccagtatcgaaacgcaagctggtgacgagtctagtcaaggaaaagagctccaagttctcactgtcaaaaaagctgcatttaaggaaggacgatggctccccgagtttggcgccagtgtcatcctttgaatcaaacagagacctgtcgtcgacgtcttcgggaactctagactcgctgctttcctggctgagcagagcacgaggggtggccgagggattcgtcttcaagcacatggctattcaggcgtatgagaacaaccagattggcaaggctgtaggcgcagcttatgcagccattctgcaactggaagatgtcaagatccctcaaaagtctgctctttatattccagtgacccatctcaaggagacgctgaaccgtcaccatgccgactacaaggctgacaatgatcgtctatcgtttgagcctgttccttcgccttcagagcttgctcaagagtggccctccggtcgacaggtgatttctgctcaaaagtggactccacaaacaagtctggatcttggagaggacacttcctcctccgcacccaagtattctggccagggttcctactactagctacttgtagttgtactccatctgcacacacagtcaacacacaatccacaatctacaaaaccaatcattacccacactgtgacatgtaacatgatcaatacaatcagtactgtatgtgcatacttgtattttgaataaataactgccaaagacagtaatgcattaataaataatctggttagacctcggaggtccgacgatgatggtgatgcaatctctgggtctcctccacctgctgctgctgttgagcatcgtctgccgtctcgaatggttgtcggcacatgggacacaagcccttggacgtctctgtttccagccacttgagtagacaatgcaaatgaaacgaatgtgcacactttccaatgactgtgttagcaccacaactcattacttctctgaatcatctgaatcctctgaatcatactcactcaatggacaatcgtctcctgggtacttgcacacaggacacactccatcaaacggaacccggcagataccacaaacttcgtcgttgggcacgtcccattgccacacgctcacggcgttccactgtttgatttttaccttcatggcgttgctgtgtgttttgttgtcatgtactttacgagtacgagtacgagcacttgcctctcagcactgctcttcgggatgggtgtacatgtaccagggtgcaggtgtaaacaactttatttcaactcgtcgcgctaacatggtggtgtacaaatacttgagatgaaacaaggtagtggggatggcgagggaggacctttgggtggcgaaattaatctggtttcgacgtccttactcttcatcacttggtgttacttcttccacaattgtgcatcatcggcgaaactcctgcaggacttgctcgatagtgtgcaaccgctattgtggatataatcggcatttgtttggtatcattttgattggaaaaactctgccatttcactggcgctactgccgttccaatcaagtcattatttcgctcagatctccgtctggtgtggctgatgaaacagttaagcttagggttttgacaataaggtttccgaagcaccttttaatacaacacaacatttactcacgcgaactgttggaaaaacgccagactcacttttcaaccgtgaactggacgacccttgcgacgacgccgaatcgacacgtaatcacctcttgattgacgttcgttttcctcacgtgaccccactaaacaccccctcacctacgcccaccacaccatggccgactcggactccaagccctcctctggcaacgaactcgaacttcgagagcaggacaagtggctgccaatagccaatgtggcccgaatcatgaagtctgcgctgcccgaaaacgccaaggtgtccaaggaagccaaggagtgcatgcaggagtgcgtgtccgagttcatttccttcatcacctcggaggcgtcggagaagtgcgcagccgaaaagcgaaagacagtcaatggcgaggacattctctttgccatgctgtctctgggctttgagaattacgccgaggccctgaagatttacctcaccaagtaccgtcagaaccaaaactacaagcaggagaacagaagcgagaatcgaaagaagaagacgctgcccgcccaagaaggagctgtggctgctgctgctaccggttcgaaccccgtcactgagacaaactcgccttcccagcaacagcaggaggagtactacgctgcctacgacgttccaattaacggacaggaccctaccgagcagcggttctccgaagagcccacccaggacgaaaaggccatgtatgacgcttataccggtgactactactaagtgtctgattggagacacatgctacggacctttccctttgtactattgatgactatttataaagtgtatgtgatatattatgactgtattgtactcgtatttgtacggcggttgttgagctatagtttttggcatggaacaagcgcgagatatgctgtggaaatgatcttcgtggagtgctacttcttttgtacttgtagtacggtaagcagacacagttcatagagtgagcaccaccacagctgtacaaaatgaagcgctgagacgtccggtatcgtaaatgtgaataattcaagtatgctagtagttgtgaattacaccaacacctagtagttgcattggcatttctcttaacaatctatgacttgtctgtcaagggtcgaacgatgtacacttcaagcagtggccatgtcctcgacatcgttctcaaagagaagacacaaaagatatgaggacttctccatctactaaaataggcctcgataagtaattaattccgtttttcccgctaaaatagtttgatttagatccgctttgagagtagggtcagagcaagttgttgttgaagtacttcaaatgattagtgtgaaagctgcgatcagcagaactgaaacaaaatttgatgaagtaaattatacacaaattattatcttttgataccacttactaagcattttcagggaatttaatggatcttatgagtgtattgtttcaacacttttcagtaggcatatttgggcatcctggccgagcggttaaggcgagagattagaaatctcttggggtttccccgcgtaggttcgaatcctgcggatgtcgccatttttttgcgtcgtcttcctagctacagaataatacttcagttcttcttttcgcatgattttttcttcctttttgatatcccccttgcgtttatgaagttttggagagagtagagtcttattcgtctttttgtacgtcttcttgcctgttcgactaaacgcatatcatgagttgattgtttacgcgttctacatcaacacgcgttgttcgacattttcagcgcagaatgaagaggaaacacgacggagattcgacagacgacgatatatctggtcaacagaaccactcgtattcggaagcgcatgtctacagcgtgctgagatcggtgttcaagaaggacgcgtttcgaggatgtcaaaaggagatagtggaggcggctatgaagggaagagacgcattagtgttacttcctacgggccacggcaagtcattgaccttccagctgccagctgttgcagtttccaagggcgtcactatggtggtgagtccgctactagctcttatggctaaccaggttcaggggcttaagaaacttgatatccctgcagagacactgaatagtgacgtccagggtcacgacaggcgcacaattctgcaagatctggtcagtgataaccctgaaacccgcctgttgtacctgtcgcctgagtacatctcaaaccaggcatttcagcgcatcctcaagcgtctttacgatcaggacttgctggtgaggattgtgattgacgaggcccattgttgtgtggaatggggtcactctttcaggtccacttacaaagagctggggttcttacgacaggagtaccccaatgttcccatcactgctctcacagctacagcatccgaaagcgtccagaaaggaataatcgacattatgggactggacgagaagaggctgggagtgttcaccacgtctatcaatcgctccaacttgcattacgaggtcagatacctcatccccgattatcgcttcacagactcgaacagtattcaggaagtggtcatgaaggacattctggagtttctacaagactacaaggaacgcagacaggcccagaagtcgacatgtcccggtgcaggcattgtgtattgtcgtacccgagccttggtcgagaaggtggctcagaacttgggtaggaaggggtatggagctcatgctttccatgcaggcatggatctcaacgtcagagaagatattttaaccaaatggacggactcggagcccggctacgaaattgttgtagccaccattgcatttggaatgggtgtggataagcccaacgtccggtttgtcatcaactttgatcttcctgacaacctggagtcttactaccagttatcaggtcgagcaggcagagacaacaagggcgccaggtgtatcatttactattgttcaggtgcccatagccctactgcgaatgccgatatgaaaaggtactgttccaaggccaatcaatgtcgtcatgtttctattgctgaatattttgaaccccagaagacgcgaaccgtcaaggagagaacccagttggcgaaagaatactgtgattatgcttgcgatgtgtgcaaaaataagcagtttgtgtcttctagatacatggcgatggttagagctgttgactccttgtcggagggtgtatctagcactcagcctagttgttccaggagtttagccatcaagtgatagcttctttgtaaaccctcgcaaagcatcacataaattatttgtatttataccaatctcataccgactaggtggctcttacagggttgtactgttgaagataatttattaattttacattggtttactcgtcgtcgtcgtcggagtaagacataatcttgacctccttcttgaagttctcggcatccttggtgatgagagccttgaaagcctcgggatcatcagcaaactcgaccaggaagtcgatctccaggtcgtgcacgttgtttccaagcacaatcagagagtgcagaggctcgccagactcgtactcagcaagctctcccagagaaccggccttgatgcattgtcgaggagatcctagtcgagagacagcaatagctggggtgtcggaacagtacaccttctcatctcgagattcctcaatctccagcagctgggaagcagcctgctcaatagacatgtatcggggaggctcaaagacgtttcggcctcgcataatgttttcaatgctctgctccttgaccttgatgtcaagaagaaccagggtgtgcagaccaatctttcggttctcgtggatcttgtcatagaaagaatcgggcttccatgaatcggtgaagaaaacgagagacacggtctggccaaagttgtacagctgcagaccgcaggctccaacagcattcatgaccgaggcgttgtggatagtctggtatttgattcccagctctcgggctcgaatcaccaagtcggtatgggtggtggctccaaaggggtctcccaccaccagaaatgcaatatcgtcctcctgggcgccggccagaatgtcgtcggatgcctgctcgaccatctctcggtcggccagaatgagctccttgccgtagaacttctccagggtctccttctcggcggccatgagaatcgaagtgtacgcctcgaggtagactcgcttgcactttttgatggtctccagacctcggacagtgatgtcggtttcgtgggacagacccaggccaatcagatgaagcatttcgtgtagattgtgtgtcaaaaattggatttttgggaactgaaaaactcaccaaaattaatttgcgtgggagtgcgtctgacaggtacgaggttaagcgggtcattcgagatgggtggggtgagttagtgcaaatgtagagggtaggtataatgcagtgaaggagatttggtaaccccctccagacaaattgcttccttgtttcattgcttccttgtttcattgcttcattgcttccgtttatatcaaccacaacagtagttcactactccacagggaagtcacttgaggatcaagtcaatagtggaagaaaagtatagtttgaagataaacgatggcggctcggacccaataactttttcatgtttggttttcaactgttcccctctctgtttactagtttagtacatctgttcaatatatatatttgtctatatagagcttctttatggactcaacgattcatgtccatcaaaaaacttgtgcatagtgcaggtacgatatgatactgtacaataactgcaagtgccagaaaaccatacgagacgatatgttatgattcattatagagcgataattggatcgtggtatgtgtgcatattctatacagggttagtcaaactcacaatcactcctcctcccctcacacttgcgagctaaaccatctccgtttcgccatgctaccatcggagatactcgaccacatttgctgctacttagatctggaggctctcgtttcccttactcaaaccagtcgagagctgctggaattgatttttgaaacaacttaccgtgacgtgcttctgagatattgccccttctatgatctcgactacagccaatgggacagctggaaggctagtgcccttcacttttcaaaggtggacacacggcctttcgagttgagtctgaaaaatccaattcatatcaacacacctcttccagacgatttccaatgtttctgccgcggagcagatctgaaaagcgaaattgtctacgaagatagcggtgtcttcatcgagaacaagtttgtgaatctcagccaatcgcacaggaaagtcccgccttcccctatactaatgtacattgacagcgctccctttggcttggttcacgagatcaattatggcgaggagtctatgaaggtggtaggcgacttccatcgatctatttgcacttcgcagataatggctgctgtttcaacctatggagaccagctcggtcttctcatgaaggatcttacagaaaagatggaggatcccgaagaagctcccttgtactttgcaagactacatggtagagggccattcagattgcaagctgtggggaaaagggtgatcctggtcgtcacgggacacaagggagagctattctcgtctatattcagcgcgcctggcggattcacgaatcttgtgtacacgaaaccgcttagaaaacttcctgctgggatgctcttctacgacggccatgtttacgacgtgttcatgtctctctcgaagaagcctgttgttcagagcaccagatccaactcgtctactcctgaagagtggaaactaaacagataccacaaggtggaacaggacgaacgacacacacaatatgccttgatctacaaccagcatggagtggtttctgcgcttgtcgatctgaaggagcacaagatccaaaacttgatggatactccaaatgccccgcaaagctttggaacatggtcgataccgacacaagcttttggcacagagcgccacctgatctttattggcatctccaaaggtgctgtgcgcattcataagtactcggagacatatttggcagataggtacaggggccagaatcacagaagcatgccgatcggtctggatgtatttcatcctgctgaggaggactccaccgatgttcttacctattcaaagttgaattccttcgtcgaccggtttgcgggtttgaacattccttcttggcccggggagtgaaagcagcatacaggctctcaatctgatctgaaacaacaaaaagcaaatactacatgtacgagtatgagtacttgtagttccattaatgtgcagcacattgttcactgtgtgtactaatagcacgcggcgcacctttcctccaaaagttgtcgctcgctagcttaaggcaatgtctgcaaagattaagcacatgttgctaccttccataataatcaatatcgccatgttgttcgtctttctacctcaatcacatgtggatggcatgataatggcgacgcagaaaaagttgaaaataaggccattccgtttcatgtgattgtggggaagagtacagacggtggcttcggtgcaaaattgtagatctaacgttgtttgtcaggggaaccgctacaataggtggggaagttacaaaggtctataccgacagttatggagaaaaaatggagaataaaaatgtatggacagagatttattgtctcttaaaccccagtaagagaattatccaaccattttttgtccattcatggcagctatggaagcctgtctccatttgccaccatcaccaaaccccgccttacatatgcaccatgataagcacaagtgggagcaaaggcgttaacacacctaagcctaaatatatatagggttgcccaaaaaagaccattcatatatttcacactcgacgtctgtctcatttcatctctcttgaccacgtctgaaaacttgtcgaacccccacaatgcccaccattcacacagaaatcgaaatcaatgctcccgcagcagtcgtcagccagattctgtaccagtttaacaagtaccccgaatggaacaccttcctgacctttgtcctgggcaactccaacgactactctcaccgaccccaggagctggccaacgaacacatcaccatccaggtgtggacccccggcaagcagaagccccaaatctttgactgtgtcgtcaacaaatgggagcccaacaacctgtcatgggagggccatctgctcagcaagcacattatcaagggcgagcactactttgagatcgtgcctgtgagcgagaacaagtgtattttcaagcatggcgagaactttagcggcggggtggccgcagtggcctccttcacctctgtgtttgaaaacctcaagcccaactacgagcgaatgaaccaggagctcaagaagcgggctgaggccggcgtctcaaagctgtaagcatgctcatgcacctgaaatgacatgacatggcatggcatgatattggccattgcaatggaacgcgctctgtgtgcaactacacacacattgatgtatatttaattcacggtaacttgtgttgcccatgatcctaaaacaccacacccctggcaagatttcaacgctgtactgtagactgactaccattgctaaggcagcagtgtagatctcgctgatatattaaagttgcgtcgggattacaaccgacaccattccaaacggacacaatagtagtgttgttacgccgaaaatttgacaggttccttcaagactgatcataatccgtcgtagtgaattccagcgaattctttcaggtattcaccattccagagaccctcagatttcatgagctcttaaagccctaatcagattaggcttcaagggatcgagacgttttcgtgatgacataaatacagaattggagacttgaaagaagaaaaaattgatatattaaatcgagatttttagtccataagaatacatcaacagaactacttgaagatttgaagatttgaagatttgaagatttgaagatttgaaatcattcacactcactcataatctgttttgcttcactgatgagatccatgagatcagacacgctcccagtatttaccagtaacttttgttacgctacttaaacctacaaacacccctccaaacatccagccctaaccctaaagaacatgaccatgatttgttatgttttctatacaacctaaaaggacaacagggtctagccaactccacacaacatgaggcttttcgtagctacactataccataagtatataagcagggtatacagtctctttttgatgggccggatcaagcaatctgcctgtgttctcctgtaataacacgtctagccgcacacatatgccgtgtcattgtatgcattgcgtccacgtgtcgtgacggtgtttgtaatgtggctgtcacatggacgtgtttatctcagtcttcatgacttcctcccgtcatgtcacttcatttcggttgtgcttcagccataattttctgtctataaatatatggcttttcccatctacgaaatgacgttatacaccctggagctaattactgtgcccacacacatgtctcagaagcatacgcgtaaccaaggttaactatattcgactgggagtgcatggaaaggggcatcggcgaagagatggacggggggtgaggtatttgagcctcgctggtcggtttggtgacgagttttgcggacgacagcggaactcgctctttgtgaactgacgtcgcgggattttagacccgtttaggccgtcttccccacgcttgttgaccgctgtttatgccagtcagtgtcgggagctaaaaataggccagtgcaaaaataaaaatgcgttatgcgctgttccagcaaaaaccaagtgccaaaaaaaatgcggatggcgtaaactctccagcttcaccagcaccgtgatacagactcagacgagacacacggtccagcacgagacatacggcacagacacgagcacacatcaaccctcgttacacagacgcaactaacaaaagaaaacacccggccccacaccgcctagcccgccatcaagacacacatactccgatagcacaccagtcgtaacatccaccacaactgcataccatgaagctcaatcccatggtcctggtgctggccacggtagccctggcctccaccatcacaactccccctccacgagccaccctggctcctcggcaggacaacacagattccaaggatgacaacaacgaaagtatcgtgacccggttcaccgccaacaagagcaaaaacaccttcaccgaggagccaccgaccctgacgctccccggcatgcccacctcggagcctgtcatcccctacaccgaagataacccctacgtcaacacatccaagtaccccgagggcaccgtgttcatctgtgtgggttccattctgggaggtctcacactgctggtcacggcatggcgattcggtgtcgcatggcacatgaagaagcaaatcaaaaaggccaacgctgccgagcctctcatggctgcttaccacaacaagaaccctcggcccaaacgtaagttcgaccacaagtccttgttccccacggaaaacccgtttggaaatcacgcagagctgtccatggacaacctgtcgcctcagggcaagagcatgtccaaagcgcaggcggcctccatggccgcccacaagtcgtcgcttttcttctctcctactgccgaggtgatgaacgcccagaaaaatggtggaggaatgggcgaaatgcagcagcagccagcctaccacccgggatcgtccgcaaactcattcatgggcttcaacaactccggaaacagatctactgcatacctgccttcgggttactatggccctcagtctggccagttgaactccatgacctcgcagtctcgagccagtatgagaggctccatgatggctccttccatggttggaggacgggccaactcgctgcgacctatgagtcacatggacggacagagtggaaatattggaggagtccgagctccttctgctttcttggatgacatgctcaaggacgacatgatgagtgaggacgagagagaaaaatagctgtagtgagcaacagtgagcaccagcaggcaagtgaaatgatcacttatatctattcacgagagacgagagattctcatgtcggtccctgtcatctgcagaggtcttgaggtctgaggaatgggctcagacaggtattgttggtgggttattcgatggcattcttcagtgtggtacgcatctgtacccgtacaagcaactgaaaagtagtagcaatggcatgttaatatgaaattatgcggatgatcacggtgtagttgacgaggaaatcgctggatgtaggtggtgggtgaagagactaccaaggacgtgaagatgagagatgaaagcacccgtacaatacttctaacaggccaaaacaaaggtgtaggcgatagaaactccgttctcgtttaaatcctgtacagttatcgaatacatctctctcttaccgatgcgatagaggacacattatctgctccttcggctgtcagtgatatatatatatatatatatatatcttgtgtgcgatttaaaaaatacggctgcccctgacaagacatgtgtattacatgttttcgtctctacaaaatggtcatataaatatcaatatctattatttaatatatacagtccgtcctacaaagtcgtccctttcattggacacacttagtaagagctggcagcctgctggcaagccttgagggcctggaggtaccagtcgcagatctgcatgtttccgttgttctcgtcgaggcacttggtgaaggctcgggcgtcggcctcacaagcaccggtctgctgctgctgctggacctgggcgggggcggcggccacaggagcagcctgctgctcggcgggagcggaagaagatcctcctccgaacatgccagtgattccggcacccagagtgtggccaatggtggatccgacggcaacaccggcggcagtagaagccatctgggcgaacataccgggctgctgaggggcggcctggacgggaggagcggcggcaggaggagggtggttgtagtgctgctgctggggatgagccatggtggaggcagatcgggactgagaaggagcggctcgggcaggagcggctctggatcgtgttctagccattgtgtttgtgtgttgtgtgtaactggtttagtttttttttctgttgtggtgggtagagggaacctcgtggctatataagattttcggtagccattttcgaacagtctcgaagcttgagtctatttgccacctatgtaaaagcacgtaccagtcgcacgaaatagaccctctgaatagagctctatgtacagcggtatgatagccgagtcggagatctggtcgaaacatatcacatgtccctcgtgtactacgccaccgctatttcttcttacacatgtccgccgttaaccccgctccttagtcatcaatactagaaacctaaccctcgagataagttacagtacctacggcggagctttaggtcggggcgtgggcggactggggcaccagagagaaagttgtataatagagcaacaagtcacgtgaggaagtagtgagggagacattttggaaggtcttggaatactgtggaacgttacattgtgagaacatcactcttataaatacatcctgttgtgtgtgcttatacacttacaagtgtactcactgagtgtccgtacacaccctgctgtactgtaagtaagcgctgacctctccctccagacgttgaatattaggttgaaagtataaaccccgcgttgtaaaaagtgcacacagtgggtggccaatcagaaccgccgagtagtcataatctgtgggagaggctgaatatcaaacaatgtctagaatgtggttggtcgtttccttttttggcgtttttgaagggttaatcttgcatctcattcacaaaatatggtggattctgaaggagagagatgtaggttcaaatttgggggaaatataagccgaaaccgtagtaggggtgaagttgagggggaggtcgttgggacgccataatatactgtgttgtaggatattctgtgctaaaatcaacacaaattaatggaatagagtcctttagaagtaaatattcgcaaattgcgtccaaaaaatacacccctacagagcccgctcacagtcacctgaatcaactcattaaacgttgctaaccaactttatccactacttggaataaaacaaagcagtcttcaaactcccccaaaagatcacttattgaaactatgaaacttgcattacaataaccgtccctttttatccccttttgtatctttatatcttcctgttaaacctctcaaactcgcaaaacgtgattcctttgagcttgggaagtttggctggtcagacttccacacataaacctccacccaatgaaagccgagctattgaaagagggagatggtagaacgatgcaattgggctttttccacgggacaagtcgtgaattatatagctacgggccaattgtcttaatctactgacttcttaccaccacaaccacccccacaacctatatacactccttcaaccctaacccccgtttgcgccaatcagcgttctcggaatactcccatctggactaaactcttcacagcgaccgaacctctgttacacaccaaaagcacaacccctcacacaatgctgcgatctgctgctgcccgagccgtcagggctgtgcgcccccggctgtctgctcgatacatggccaccaccgctctgccccaggaccccatcccctccggagctctgggccagaaggtgcctcacgtcgatgagagccaccaggacctgctgttccgaacctctcacatggtggaggatctcgagacctacgacgaggactcccctatcaacacgtcggacgccaacacccgaatccgagccttcaccatcaactttggtccccagcatcccgctgcccacggtgtgctgcgtctgattctggagctgtctggagaggaaatcattcgatcggacccccacgtcggtctgctgcaccgaggaaccgagaagctcattgagtacaagacttacatgcaggcgctgccatactttgatcgtctggattacgtgtccatgatgaccaacgagcaggttttctctctggctgtcgagaagctgctcaacgtggaggtgcccctgcgaggcaagtacatccgaaccatgttcggagagatcacccgagtgctcaaccatctcatgtccgtgtgttcacacgccatggatgtcggtgctctgacccccttcctttggggttttgaggagcgagaaaagcttatggagttctacgagcgagtctctggagcccgtctgcacgccgcgtacgtgcgacctggaggagtctcccaggacctgcccgccggcctgctggacgatatttacatgtgggctacacagttcggtgaccgtctggacgaaatcgaggagctgctgaccgataaccgaatttggaagctacgaaccgtcaacattggaaccgtgaccgcccaggacgccttgaaccttggtctttccggccccatgctgcgaggatccggtatcccctttgacattcgaaagaacgccccctacgacgcatacgacaaggtcgacttcgacgtccccgtcggcatgaacggagattgttacgaccgatacctgattcgaatggccgagttccgacagtcgctgcgaatcatcgagcagtgctgcaacgacatgcctgccggcgccgttaaggtggaggacttcaagattaactcgcctcctagaaacctcatgaaggaggatatggaggccctgatccaccacttcctgctctacacaaagggatactctgttcctcccggagagacctacaccgccatcgaggcccccaagggagagatgggtgtctacgtcgtctccgacggtagtgagcgaccatacaagtgcaagatccgagcccccggatttgcccatctcggagcctttgatcacattgcccgaggacatttccttcccgacgccgtggccattattggtaccatggatcttgtgtttggagaggttgatcgatagtcatagaatacatactaagcagagtcgcatatgcgtgtgctcgtggaatgtactgtagagggttgtacactgtatgtgagagcagagttgctataaggagaggtggtggatgcgtgactgttagttggactgtgagtcagaatggtccgttgagagcaatgtgggtcatgctaaatctcttaatgctttctcttctactatggtgatgttacctcacagatacaacaatcgagatacgggtcgcgagacgagtagatgtgagactacaaatactgtacacttgtataactaatctacaggacaggtgaatgcgaaagtaaaatgcgatcatctctcggccgtagatggtcatattagtcacatataatctgatgccggtaaatttcacatgtcaagcatgtccatatggatctgtcatcaagcgagacagccaccaagactggaaccaatgccgctggtagtaatggaccttctggtaccagagctgtcatcatttgcttgaaccacctccttcatatgctcacaaaatcacatggctgtggttcatctcacaccaatcctttgagcatatgtcattcatgtagcatgcataaacatgtcatcaaagaaacatattggggcgatgggaactgataagggggtggatgaacatctgatctattggatgaactcgatataaatgatcgttaattgaactacttgtagttattacaaacacttttgcaagtgctagatcatgattacttgtgtacacctactgatgcgtgatcaataggtaaaccatgatctggtgaataccattacctgtcccctggtgtacataagcatactacgggacaacttctgcacagagagagatcattctctccatgacatactgtataaaaccactcgctcctacacccaccgagctaagctctcatgcccacaatcaataacacaatccattctatccgtaataaatacactacatgatgacgcacttggaagactcctccttgtcatcggctgcagcgcccttgggcttagctcccagagcacatcgagcagcctcggtaaaagcctcgttgactcctcggttcatcttggccgagcactcgaggtatcgaagagcgccaatcttcttggccacctccaggccctgctcgtaggtgacgtacgtcttcttggcgccctcgccgccctcctcattgtttcgcagatcgcacttgagagccaccagcaccaacttgacgccctcacagtggtcggcaatctcacccacccacttggtctgcacgttttccagcgagtcgcgcgagtcgacggaaaaacacagcatgatggtgtgtgtatctgagtacgacagagatcgtagtcggtcaaactcctcctgaccagcagtgtcccacagagacagctgtacgggctggccgtcgatgaaaatgtcatgcacgtagttttcaaacacggtgggctcgtacacgtgggggaagtatccccgagtgaaaacgttcagcagagaggtcttaccggaagcaccatcacctagaatgacaatttttcttgaaactgggttagaatgataatgagctgtggtatatttggagagagagagagagagagagaaggcgtaagagtgtaaacgaagtctcacaagtggtgagaaatgagaggtatgaaatggacctggtgaagtcatgttcaaacgtagttctgagaccacatccaagacaatgcctcatgagcccacatatgttgcaagaaacctcagtaagcctgaaagtccacactcagattgtgccctcaggtcctggctccagattcagactccaccaccctcaatactcaatatcatgctcatgcgatatggcatggcgccgcagacaatgggtatccccgctggtgtcgtaggagggcaactcgatcgatgtggcgtcttttaatagcaatatcgcagtgacaactcgggggttgcagtgccacatggcgtcctcagaacaccctcaacattgtagctccgtccagatcatatcccgtatatgcttcagggtgcgttttggcgcgcacgcgtgttgccgtgtgcgctgaaatactcactagccttgggggctccgccgcagatggccatgttgaatattcgaaaatgagcgagagagtggaagagtggtgcgttttacctcgtaacggtatggtatatctcttggtgcaggttaggtggaccacggcttgttttggtttccagcaaagcttatttgcgagtctatgtttttcccttgtgctcttgtagcgctgcgcttgagccagagtccaactgtgaggttacacctcccacgcgagtgacggagtgacgtgtccaccctatcagctgcttgtggcaggtgtacttgtacttgttgtttgtggtgatagcatagactagtttgccctcggcggtattacggggtgctacagctgtggagacggtgtttcccctccttattttggcatagtgcgccttttacgatttttttttcttcccatttatgaaggtgacatttttcacctacccgtttttttacgaaaaaaataaaaatataaaaacttgtgtgtccagccaagaaagcgcacagtgtcacaaccttgccccagaaaagctcgtattgacgcgaacgcgtgcgagacgtctgcgaccagagcgagtccatatctggcactacagggcccgagggccgccaacaagaccgagcttggcgtcggctctagcacacgctgagaggcgcttaccggccacaaaaacccccggtgcaaagacctctgccgctacgcatcgtctggttgctagtgatcgacggacccctgaaagtttccacccacctgtaagtgtggacctggagagtgcttaaaccgtaagtgttggagatgcactggctcacataatatgacggtccatggtgctgtgattgtgctgtacatactgtagcattgatgagtgtaaaggcctgtcattgacagtgtacagcaccgactgtgcgtatactcctatcattaccctctgaagccatatgtatgtacagtacttactgttgatacacacgagggcggttcccatgggaaccatgtctgatccgcaaatgctctgtttcagactgacaggggtgctattgtaattgcgagctatagctcaggccgatgattggtacccccaggagagtgcctataccaaccttttaattaattaagggatgctattgtctggaattcacctccacaatattatctggcgcctaaccatagtccggaaccagctcccactcggccctaaagatgcacattccgtctaagcccataatatcggactattctggcttttgacagtgacagggaaagtgcaccaagtgtctgagtgggtagcgtgggagacacatgttggagtcacgttattgtctgcttgattcattacatgttatggtgatttatcccgatattcccgaacatgtggtcgactgtgagtagcgagagctgcatccggatcgtacaagtaaagagggtagttgggtcatttgttgaagatctcaactaatagcaccacctgccaagttggaaccatcaatggaatgaacaacacctgtctaaagtacaagtatgtactgtacaatctgtacttgtgctcatacgacacgaatggataccaccagtgacagataactcctatccacgagcatagatctcgtcataccaagaacgaacgccatacccgcaccattgaccactcttttgcccaacttgcaaaatcacgtgacatggagagtttgcttcaggcacatcaaggcaggagcctcagttaattagacctccaaatatctcgtgttctttctacactaatggtgaagttttcagcatgaagaaacgaagattccagatcagagcacttttaagattcaactttattgcgacagtgcaaatgggtatttggccaagtggaagggggtatcaagcttggccaatagtggctatattttgattccgaaacttttgatcaaattctgccctgaaaacaactccgtctatgtattgttgttcccggaattcctgggggaacgctccgaaaagtctttccctttcccaatctgttgttccccaacccaagcctaatcttgagtctttcccgataatcttgcatggcactgggacttgtaatttcacaagttacaggaacagcagtcttacagagtccaccatgtggcgactaggtcctcgacacttttccacgtccgccgctcgggccgcagactcgtcgacccactactcgattctgggcgtcagcgtgtccgccacggcggcagaaatcaaaaccgccttctaccagctctccaaggtgtaccatcccgaccgggtccgcaacaagagcgaggaggagcaaaagatgagccgtctcaagttcgaggaggtttccatggcctacacggtgctgtctgatcccgctcagaagcgagactacgaccagcagaactcgtaccgctttaatggaggctcggcaggcacccagggcaaccccaacactggatccggattccacagcactggaatgttccgcgaacggcctgcgtctggattcaaccgacgggcagacaagcaacgtacgtccacgttccagggtggctaccgaacgtcgaaaatgaaggcaaacactgcttcttcgcgtttttccggagaacaccgagaggcgtccaactacgacgtgcctcactttgactacgataaacaccaccaccaacagtgctcgtacgaagaacatagagtgcgacaccagcgccagcaggacgaggagtttcgacaggcccgacgcaagaagaacgaagagagacagtatcatacccagggaggaggcattaacgtcggagctgttgctgggttgggggccacgggtgtggtgttgattgccatgatgtgtagatagcgtgctagacgagccaatcgatgagacagtgacacctcattgaagaattcaaaggtctccattcaaatcgaacatttacagccatcgagcagacgcatccaagtgacaccactggcacccatatagatatttatagatatgagtaatgaattatgtgttatgaggcaatagaggaggcgggactacggttcgagtacaatccacaacgtccttgtacgtgtgtgtgtttttctctcttcgtactgttgataccagtatctacgatacattgtaagaagacataaagaaaaaattacagacaacattgtgtggctatatccatcatcgtgctcgtactgtaagcacacgaggtaaaacagcaagatccgctacaagtacttgtacgttgttgtacatttgtcaaatcacaccgaagccgtaagagcgtggcaccatgacactttggtcacgcaaacaaccgttgttgcatccatatggcggccagtcaggtaacaaatacaaatgacagtagcaagtcctctccctcagcctgctcaagatactacacctcggcgacagcgccgaatacgacaagaaagctacaagccaacataccgtcagtcagacacactgattacatatacagaactcattaaagtattctaattaaccctcaaaggtgaaagaaacaccgaggttgtgggcggactgctcgagtcgctgggtgtcgatggaagcaccgacaccgactcggacaccgggcttgaggccaacagagtaagcaagagcggcaataccctggttgttgatcttggccttggcgaaagagttggcatcaagagtgtgcttggcaccgatctcgagaccgacgggggcggcagcagccttggagtcccaggtggccttggcaccgacctcagtggcggggttaacccggtggaagtaggcggcggagaaaacagagagggagttggtggccaggatggaggtggagtagacgggggcggtgtaaccaacagcagcagagtacttggtgaccttggcgtcagagacgtcgtatccgacctcggcaccggcaatgaagccgtcgtggccaagagtggcgtcggaggtgacggtggggcccttcaggagatcgaagaaagctcgagcctggaaagagggctgcttgaagaagagagagagcttggcgttcttagcaccggaagaggggacaaaagaggtggcgagctcacccttaagaccctgggcaagagcctcatcgatctcaatcttggagtcgaggacgttggcggtggtccatccctgggtgacagtgacaccgttggccttgtcggcgtacttggcctcgaggttaccggcaatggagccgtccttctgggaagacttacccttggcgacaaaggcaacaccgttgggggccttggtcttgatctcgagggaggctcgagcaaggtggtagtagtccttgttgaggaggtcgttggaagccttggcgatgtcagagaaagcgagaggagccactgggttagtacgtgttgcgtgttatgatgcttcagcacgtgcttttcgggtgtcatcaagacgcgcggcagcacagcgactgagaaaaaaacaatcgtcacctccagacggtgattgtggcagttgaaggacgccatagactcaattgtgacgggagacgaccattgaatgccgatgtgtcatagtgttgatgcgtttgttggtgcaaaacacaatcacaccctgtgatacctcccccccccaagacacatcatgaatgcgatgggctggttaccgagacccgtgatgggcaccctcaatggccccattgtcgggtctcacatcacaggctgacaatgtcgccacctgtgtttgcagcccgattgatcgcaaaaccaccacctcggttgttactcggtacctctcggttgcgtgtcaatttgcgttgaggtgaatcaagccacgtgcaattgagtcgagagtgccactgtggatgtgcgtgtgttcaatggaggagagggcgttcggcgcctcaatggcgctgtgcctgtgtcgccacggtgactatactcactgtttgtgtatgtgtgtttgtgctgagaaagaagacaagttacggggagcgaaaagctacgttagccactgcggtgagttagttcctttaatctgcggcgtaggcggggactgcaacaaagacggtagacgcaccttgatcaactaaagttattaaggttccgaccaatcaaaattgagctgccgcacaccatacgtccacataaacatacaagacagcccagaggaaggtccgggtgggaggcggtagggagggcaaaaatatgtgcggcttgatctgagcggtttacagcttgtttctcgggccgaagggagggcggcgggagcctggatggtgccctagcaggccccataggattctcaacaaatcctcacatgatctctggccccccgctctcagcacatctccttcaaaaaacggtcacatggtctgattgctcagtgcaacctcctctcccctctgttcggttctccccaacaaaatgtatcctatatgcatgtggggtggtgaactgtaacgtgttgtagtacagtaaagtaggtgtgtgggaaaggtgtcagttgggggcgtttggtgtcactctaaggtgaaactgggcacactggcacaagtaaatatataacctgagtgtggacacaacccctccaccatctgtccgaggcactacaccggcattgcagcgacctactacttcaccctgacatctcatctaagcgatctcatcgtgcatgggtgataatatctaggatcgttgatctgtcgcagacgacacacgtgaatggaaattaaaaagcttccgataaccagcaccaagccacaacgcgtgggccggaattagcgaagtgagttagccggtatatatcgggtggactatgacgcatttggcaccacgtctactgtacaggtacaggtacggtaaacacacgataattgcagttgtaatgagacgggtcacgagtagctcaacattgatcgtgcatctcggttacagtgtatgacagctgtgtacagtcagtaataagtcgttgttggggaatagtctgtcagaagttttccccatattgtagatatagaaacggccgaaggggattggtgatctatacacggatcataggcacaggcactactgtacaatgtaggatagaagatggaatatctcgcacggagagaccgacctatcaaaagagaatacaactgttgttgcagaatgatgcgatgcaaacaaacactcccacagatgctacagcatttactctgcagtccttttcggaacgactatacgcagtgtgctgaggttcgcgatctaattatgtacgagtacgagtacgagtacatactggtacgatagatagggtgtcgtttggactagactgtaccaggaacataggcgtatgagcagtggttcctgtcatcaacaatcagtacggcacttgtattatatttgaatggtggtgctcttacaaccgccgtgtttttagtatatatataatatctcgttcggtgctgtcttaagtaattactgactctacttgtaggttggacctacccctatagcacgggtcataggcaagctgaagagataaaaagtggattttccaccagaaaaaacatcaaccggaatcaatctgtcttattatagtgacacaaatactattttatagccctctgccaccacttccaccctcctattaccctgctgagaggaaccgtcctcagaaatacagttaccctgctcactgattgggacctgatttttcttgtgcatctggatccgaacatttcattccgcacctctctttggatccactccagcatgccatgagtgcaaccaaaccagccgaaaacggcaagtatcgggtggcgacgcgcggcatggtggacgaggacgtgtacgatacccgcaaccgccacgtggccgctcaccaacagcacctccggctgcgacgcatcaaaaatgtgctggccaaaagaactgctgtctctgaaatggaggcggacgtcatccagggcgaactggcccgcgacttgcgtctcttggtggaggcaggagcccttgagctgccagacattggcgatgagcaccagctggaacagctgttgcgagacgagttacagtctcacgaatcggtccatggagctgtcgatgggctcgtcgacggcgatctcgacggaaacgtggacgtagtcatggatctgaccgacgacgaagatggcgcactggaagacgaagaagaacggatgatccaggaagccttggaactggaggcccgggacattgagcatctcgtcaaccagatgaacctcgatcattagttatttatatttttccatccttctccccatgaacgccctgtgcctcgctcagctttctactcttggttagcttcgagctggatgctctcggatcctcagagatccaagttgcaatgggcaagaccaacccctttcacctcatttgagtacgccctcaactaccagtgttgtccggtgtaattaccggtgattacattttatttatagagtaaccagagcccagacatggtccgtgtgaatgtcaatgttgtacagtatttagtcgagggcacttttttagacgcttcacagtatgattgaaggtcattagaactaaaaaaaaagagtatcagttctaaatacaagtaacgattgtcagagtaagagctttcggttgatatgaacacgaccttaccgtgccactgctatgggttgttcgtctgggtaatctgtcaccggtacacttgcattctgagactggcaacaaaggatacatggcgaagctgacgaaaacagtaacatatacgtattgtacaagtacacaaatggcaagcattatagagaacagctacgatatgaaatattctttgaatttcgtggctattttactctttctattgaggtaatttgatcaactaaatatactttgtttacttaatactattgttggatagctggtgtgtacaagacacccagaatcagacaagagaatagtgccttaaaagagttatttagtgacttaaaaaaacatacatcttggaaaatgccatatataagacaagaacaacttccccctgtacatatatttccccacattctgcccaagtggcgttagaatcgcctcgttcgctcaccactgatacgggtaagggttctaaaattttatgaagcttattcgaaattatttttgaagtttttcaaactcgcatattcggccacagacacagctatacactacacattacacacaatgggttctgctaaacgatcagctgacagtcgagagaagacggtgtccaagaaggtcaaactggtggagaagtccactggcaagaagggcgccaagaaggtggtcgaggaggtcgaagaggcttcttccgaggaggattttgcatctactgatgaggaacaggatcaggaggaggactccgatgactccgattctgacgacatggagatgagcgacagcgacgaggagaaggaggaagatgacgaagaggacgctcttgacgacgacgaggaggatgaggagaccaaggaggacggagaggaggcccctgccggcaagtctagtgctgccgagagccatgctgagcagaagcgcctgttgaaggaacgaaagcttgctcgatctggaggagagagtatcgctcagatcaagcagatttgggagcggctccgaatgaagactggtgtcaagcctgctgagcgaaagcagctggtggaggatatctgggccatttccaagaacgatatcaagaacttgattctcaagcacgacgcatcgcgaattatccagactctgttcaagtacgctgacaaggagaagcgagagatcatcacaaaggcgctgaagggcaactactacgacctggccatctcgtcttacggaaagtacctgctggtcaagatgctgcattacggatctgctgccgttcgacaatctattattgacgagctgcacggccggttccgaaagctcatgcgtcataaggagggtgcctatgtgttggaggatgcctacagagactacagcactgctgctcagaagcgacaaatcatccaagagtttttcggtgccgagtttgccgttttccgagacgctgctggcacaaagacccttaaggatattatcgaggacgcccccgagaagcgacccatcatcatgcgaaacctgaacgaaactatcactgctgctgtcaacaagggttccattggtttcaccgtcattcatgctgccatgcttgagtacgtcagcaaccttgacaccaacaactcggagaagaccgaattcatcgatctgattggcgagcagtttgcagagatggtgcatactaacgagggatcgcaggtggcttgcaagactctggccatggcttctgccaaggagaagaagggtcttctcaagtcgctcaagagctttgccgacaccctggctgctgatcagtacggacacatggtcatgatgactgcttttgacaccattgacgataccaagagtgttgttaaggccttttctggtgagctctccgagaagcccgtgcatgagctgttcatggacaagaacggtcgacgacccttcctgtatgccatgctaggccgagactctcgatacttcaacaagctggttctggatcagctcaagcagtacgatgagatgaagactgcaactggtactgccaagaaggatgatgctcttcgactggaggagatcaacaagggaatgtcccctctgattctcgaggccattgccaacaacgcttacgagctcatgaacgacaccctgggttctcagttcatttccgaggctcttctgtcgtgtgacggtgacaagtctgaggctatcgctgctcttatggaggttctgtctgccgatcccgccggtgacaaccacgtcatcaagcagcccaacgctcagcgagctctgcgaaccctcattcaacagggacattggaacaacaaggagaagaaggtagtcaaggtcgagactcccatcgacttcggtgccaagttctacgatgcaattggggatcacgttgtcgcatgggccactggagacggtgcttttgtcattgtgactctgttggagaacctggaggacgataagctgaagaaggagctcaaaaagactctcaaggacagtaagaaggagattgctgctgctgccgaggatggaaacaagggttccaagctcattgttgacctgctttaagcgaaaacacgttgtataaagatatatttggtaatagaggtatgataggataagttgaggatactgttttactacaagtaaagagttgtttgccactcgcgtacaagtgcatacgatagagagggatgctttgatatatacatatatattttttttggaaagatcaatccatagatcagaaatgttgagaatttccaaatgaaatagaaggagatcgaaaaggaagtattaacaagttaccaaggtatggcatatttaatagttggaaaataaataaataaaactaactaaaaaaataaaaaatcaaaccaaaaaccaacacaaacaatactacaagtagtctcggtggtagtcacaccaaatacccatctaagcattttccttgatactcgcttctatgcatggcaaaactctatatcaaaaaaatcccaaattattcttcacggtgcagggaaagatatcaccacttcttcacaacacctttgacaaaatggtacgacagttcaagcaccacgagggcaagctgctcaagaaggtcgactttgtcaactggaagacagataatggccaccgtgaacagcaggtgatgggcaccttccatctgcaggaccgagacgactacaacaagtacaacaaaatctgcggtaagatccgacaattagcatacaagctatctcagctccaaccggacgaccctgttcgaatcaagcacgaaaagctgcttctcgacaaactctaccagatgggcattctttccaccaacaccaccgtttcgcatctggagaccaagatatctgtgtctgctatcgccaagcgacgactccccgtcatcatgcacaaactcaagatgacccaaaaactggacgctggaactgccatgatcgagcagggtcacgtgagagtgggtcctcacattgtcaccgaccctgcgtttctggtgacccgaaacatggaggactttgtcacctggaccgaccgatccaagatcaagaaggccactctcaagtaccgaaacgagctcgacgacttcaacactatgtaagtttttatttatgcatgctactattagacggaatgagaaggcgtgtagagaacatggagaagtaggggatagtccgcttttttattattgtcaagtcgataagaacactatcaggtgaaacgaagacattcattgctatatgttcaactaaatgacttcagattttgagcgtcgtctccttaatcactgtgctcttgtctgatctctcggttgttggtattgtctgggcgagtatgtcagttacgatacaagtactaccgttgtagattcatatttgcaagaaaggctacaaaagatacacgccgctggtacttgaagtcgtactactatacgatatggtagaagcacaagactctgcatctccttggttctgtctctcagattacaagtgaggcactggacctataggctagcattgtagccacaaccaaaccacttaaatcgaagtgatgacaatcaagtgatcactttataccactaactactgtcgggtccctgtggtgactctattataccgtatgctaattattttcagactaagccgaagcagcctgggactgggactcatgcacggcctccagccactgggtggggcactggtaagccgagtgacagggcaccaggcgcacaaagtcgccgggggagtactgcacgtccttgagaacctcgccgtcaaaggcacgggcagccaggattcgcgcggggacgatggctgtcttggacagcactgtgggatgccactgggccatgtgtgtaagggcggcgttttcagggttgcccggctgctgtttccggaagtcctcgtacttgtactgcagagggtctcgccagtagtcggtgatggcctgaccgtactggtcgttggagatgatcatggaggcggaggtgaggcctgcatcgtcctgggtaagcagcagctgaatgtccttggcaggcacccgcttatacgagtggatgatgccgttgggagggatcacgggtacgtctcgcagcatgatcttctccagcttgacggggtcgcacagatcagtctccacattgaacttgtcgttggcaatgagggcgtttgagtccagccaccagattcggtccgcgtcggggaaggcctgcattgctgctcggatgatttcaaacttggcccagttttcgtagttttcgggcgtgattccgtggccgctgagagggttgaggaagtcctgatagaaccgagcgtacagcccgaagccatgtttcttggcatagttgagtcggttctgcagaatcgtcagcgacagctctgagtcggctcgcgcagcatcggtgccgtccagactcatgacaatgacagttcggggcttgccaggagtagacttggtgaatggagcatggccgttgacaatgttggcctgggtcacaggcttggacttgccgccgtctcggtagatgacctgtgtgtactgggtcaccgtctgccggtctttatcggcgccgtccttgagcttgaggtcctcgttggcgatggtggggtagatgtagggctgtttggagtaggccaccttgatggagtcggggcctccgccgagcacggggatgccagtcttgtacgtatatccggccggggtcgtgagcatcgacacaaacgtgtaaattgacagcaagatggccaggccgaccaccagggctctgaggttggacgatcctcggtggttgaatgacggtccagctatccgctgggcggtggctctgatctggcccagcaggccgccggaccggccgttgcgcggcacaaacgagttttcggagccgccgggacgggggagcgcttggtgcatggttatggtgtgtagtgtggtggcagagagcggtttgggttggatgtcggattatcgacactcggcgaagaaaactttaagcatggagtgtggtattgcacgtcatagcgggtcgcgcgaataggtaaggatgggagctatgatacaagagttgatttatcggggaggccaaagagatgttcccaagagaccattcgcttcgaatcacatgtttctaagcattactaagccgcctacaacctgtgtcgctcgaacggcgtaggtcacaatcgtcaggtacgtgtgatggacgtgcaaggggtggtactcttcgtacatagacaaagaatgaagggccggaaataggactgggtgaataattatactgtaagagaggacatatcgtaaaagtacagtaagaagcagactggaaaagtacagtaagaagcagactggaaaatgagagagataaaataagttttatcttcacaaactgatcgtcgccatccatcactacgatacatgcatcaacgggggggggggggggggggcaagcccaccttttgagactactgtttgtcattttaaccactatcactgaactaacacacgatacacgtctttcatgcaccttgttctaggccagaccgccatgatggtgcgactacgggcacagacccgatttgtggtatcgtacctggcgaacacttcgatatcttccgttcacactctatcgtataaatactctcagtgtctcagatatatgcccgtaaactactccttcttcctacgctgtagttacaccttcctcctatactctagtctggataccaaagaaaatgcaattatcgccatgctcactccttatcataagccctcatcctcctcgctcagcacctcgacttctgccagcttgtcaatggcatcaaactgagaggagaggtacgccgggtcggatccaggcatcttggccagcaaacgccccaagtcggaacgggccttcttgagaaacgaaacgcaaagaccatgcatctggcggtctccgacatccgtgtcgccaagtacggcaataccctgggtgatgagtcgaaacagccaatccgggtcccagcgtgtgcccttgagagagcccgtctccttggccaaaatagccacacggaaccagcacgtgatgacgccggtcaacggaagacccatcatggaatgcacaagagacacaatgtaccatgaatgggcgccaagttccacagaggcagtgcgtcgccgggccacccacaccagcagagtaatgagactggacatgcgtagaatgacccggtactgggacagcaccccggcctggtcctgctcaatgcccagtcgaacacacagctcacggtggccgtacagaggctcctcggaggcgtcatacgtgtccatctcatagtgcacacacagcttggaccacagacagtaaatgcggcatctgtggatcagctggagggcagaggtggccgacgacgcaaccgacgaggtgtcagactcgtcggcatggtcgtcatcggacgaaaatgccaacgagtcgtccttggggatgccaagttcttctcgcagctgggcaagagaagccacctcgtccaccccgaacttgtgtaagtcctggcccagtcgttggatcagaggttcgtttctgtacatgactggtcggcttgtttcggtcataacacagcccgagagggcacagaagcgcagcatggcccgacggaacgccaggacgttgctggcggtctttccaccatcgtctgtgtggtcgaagtacacatcacaatcgccctgaggtaacgacaacggaattccaacctccaggtttcgtttggcgtccagaatgagtgcgcatccgtacagtatacgccacaatttggccgaggacggctcgatgagcgatgcagagcccgcagacgacacgctcatggaccgcctgtgggccttgggagactgcaccaacagcgagtcctggaacgccaacactgaggtgctctgggtatcaaagttggcgggatccatgtacagaccctgcgagagcgccagctgaagaatgacaccggtaaggttgacggaatcgaccccatcaggcgagtattcggagtctggagcgtacaagcagtccagtttcatgagcacaagagcctggatggtcttgagcccaccgtgtcggaaaatatgcgacgcgttaagacatgcctcggccacctccaacacctggggacccagatacgtgttgtctcggtggccgtccttgatgcagtagtttggagggctccagtccttgagcgggtatgagcctctgccgagtcggaataccaacagcatgacggctatggacggtagattgaggtatgttcgggcattgaactgttcgccatcctcgatacgctgtttggccgaccacagggcgttgaaatccgttctcagaccctctggacaggcgcagtaatgcactgtgttgacccgtttgaggaacgagtcaatgagaaactcacagtactgctggccggggaagaggtccagcagcggcttgtagacggggtcgatggggctgtcggacctgcgtctgcgggtctcctgcagcgtttcaatagcccttttgcactttgcgtcgttgtggagcggctgcttttttctcggagaaggcggcacctccacgcccttggcccgttgacgttcgctgaggtccgctcggagcaagtttgcggcattagggaaccggccgtacatgcgctggtgcgaggacttggacttgacggtgggctgcagtggactgacgatgggctgcagcatctggggcggcgtcaacggcttttgcatcggcggcacactgatgttggagcaactgctgctgctactgtggtgacctcgggtatcgctgttggagctgttattgcccggaggctgtgaaatgggctcggcctcgtccaccgtgaactggatctcctgtcctcctcggacctctcgtcctccccaagtgggcggggcgtattcgcacgagcccgtcacgttagcagtcttgcaggccgagcacggcatctgcttgtcgcaacgcactttgcgtttccgacaaagcaggcagctgacaggcgctctacgccgccgcttgacgacccgtgaaaaatcgtcctcgaaccctgctccgggcgcagacaggtccggaatgcactgctcgtagggcgccaatcgagtgccattgttgttcacggacttgtcctcgtgatccggtagtagatccagcggctgctggtcgcgggtatctggcggtcggggaccctgtccttctctcatttccgcaatggcccggaccgccagttgctccagtccgtttcgtctagactcttggtctgtcatgagtgagagtgtgggttgagtgtgagtagatgtgattgtagtgtagtggtggggtgagtaggtcgtgtgagtagtagtaagaggcgtgtagtcgtaggagtagtcgtctgtaacgtgctagtatctgcggtcagtctgtcttacctgatccgagacctggtcaaggaataaagcgcacgtcagtcaagactccctaaagatatatccatgcactccgaagtttcgctcccccaggtaattatctccgaaacgctaatcgaggtggtgggtgtccgtggagccacgtgtggggggaaatggggaagccggggacccacaaaccgcgcgtggttaccttcagacgtctatataaaccgcattgtgctctttccaacctctacacccacgtctcatggccctccaaacgtgacggctctggactcatctcaaactctctcggataatcagcgcacatcagcctgcaacagagtttatggtgaggccaaaatcaaaggtttggggttgggactttctcggagcgcgatttaaccatgtcccaaagggtttactgagagagtaaacagcatgttgttcaagtggctgtaacatggaccaaacaatgttgcctccaacagagagcagccactgggaacttgctggcgatgcagacttttaccctctcgtcctcctggcttcacacccgccattcccccgtcacgtgaccggggcgacggggcgacttgttcggttttaacccgctgactcagcccatggtctgtcgcctaatctgaaagaccaaaatatttgggtgatgagcaatgagtggacacacgcttgcaatgggcagcctgaaacatgcatgatctgctcctccgcatagacacgaccgagtctaagcagggaccaatcgtggagtatggaattcaacggcccaagtccggaaaagtgagttgcattcaatggactgccgactcttgacttgtatgagtcggcggttttggtatgagacaaaatcttgaagataccatttaagaactagttggggttcgaacgaactatctggcagttccttttctgctgagattggactattctgatacaagtgccggtagctacttttactggtacttgtactggtcccagtgtgagagcagcagcactgttgctactcccaacaccgctccgagacgatgatttcatagcatgtcgagggttagtctgggttgatatctcttgccgtgaccctatgtatcgcactgcagtcaaagtacatccttgcgctcttcaatcgcagattgattgtagcctatagctggtggttataggtggggtatcaattgtcaagcggcagtggtcttgtttgaaaaacaagagcgaagagatgtggttttggagggttccggacaggggcttgacgtgtggtttcgagagggctgtttgcagagctccttcccttggtctcgcgcatgacttgtctccctcctcaatcactctttgcttacacatctcagctctcccattgtcagcgttaacctctggcaaggtttagtgcagatggcacgctaccggtcggcactaggtagtagtgggactaaacggaggtatgaacggacactaaccactgtgcaaacaagccattttctcggagacagcatcagaccagagggggtgaagcaaacggctttgcaaaggcccactttgggggtcttggggacaatctgtccatcttacacgctcgtccaggatagactattaggctatttcagcgatggtattttaattccgacgcgcagatacgagggcttgagagggacgaggctttcactgtacatactgcacttgaaggccgtgtgtgggaagagccaggcctggagctagtgttgcatgacaagattgaaagagaaaaatagaagaacagagaacagagcgtcttgcccgttgagcacacaaaaaagacgttctcgatccccgaacctccagccgaaacagccaagacaagaaccacggctatcctcctcctaagtttatctccggagagcttgtgtctatcccaagccgtaccatgaaggacgaaaagcaattgttgaaagatgtctggggcaagcggactaaatgcctcagtctaggggctgtttgtaccagtttcccggccctcagaggaccaaaaggggctaactgccagttttccgctattttttttcccacgtattggagggttccctctcttagctgcgccataacagcaccgctatagctgactagtctaggggtcgacctaaaaaaaacattaaaacatagatccgctgtttatatactgcggcggaagccaacaggacgtgtatccgctatatccaccatgtctcaactgcccccctcccctggatctgacattgtgcctatggctgccaccgtggagctggaaaaggaaaaggaagacgcctctgaggaagacgccttcaagtcggaaaagtctgagccggaggagactaccgagcctgttcccaaccccatggccggcttgcctccaccagatgtgggactcaaggcctggctggcctgtctgggagctttctgtggcatctacgcctcctttggatacattaacgtagtcggcatgttcgaagccttctatctcactaaccagctcagcaactattctgcatcgaccgtttcatggatcacctccctgcaaatcttccttctggtggctggaggtctgctgtttggccccgttgccgagcgatatggaccccgataccttgccggcgtgggaacctgtttcgtcgttctcggagtcttcaccacctctgcatctacaaagtactggcactttctgcttgcccagggtatctgtacttcgctgggaaactccatgctgtactacgcatctcttctgggtgtctccacctggttcaaggccaagcgaggtttcaccctgggtattgcggttgcgggctcatccattggaggtctgactatgcccttcatgttctccgagctcgagcctcgaatcggcttcccctggaccgtgcgagccattggttttgttctgctgggcatggcgctcatatgcaccgtcaccatctcttctcgaatccccgctaaccccaaactgcctcttctggacatcaagaaggatctgattgcgccctacaaaaatatgcacatctggctgctgaccgctggcatcttcatgaccttctggggcttgtttgtgcccattggatacatgtctgtccagggccagagcaacggcatgtctccccgagtctccttctacctgatttccatttataatggctgctccgtggtaggacgaattcttcctggaatcattgctgaccacgttggaggctttaacatgcacgccttctgcaccattctgtgctccgtcttcatcttcgcgctgtggattccagcacgaaccaaccctcccatcatcgccttttccgctgtcttcggtatcatttcaggctcttccatctccctgttccctgccctggtcggtatggtgactcctgtcgctgaggttggccgacgactaggcatggtctccttcttcgtcgcctttgcctgtctgacctgtatgcccatcgctggtcagattctgctcaaggacaacggttcgtttgacggctgccaggcctgggccggagtgttcatgttctgtggaggtgtcaccatcttcatcacgaaactaaccattcccggaaagacttggaagtctcgattttagcatggcaatgagaaggacagcagattgaacggcactggtagttccaggctgctcaatcttgcacaaggataatagatgctatactcggcggagctagcaggtagaataataataaaagatcatgatacctacaagtacaagtagcaaattgaatgtacagtggtgaagagatggagactgtcgtatatatagtacaagtacttacaagtgcacctatctacaagtagtgacagcaaaatcacccactgactcacttactcttcagtccgccttacagagtatgtacagtacatatataccgtatctttccgcgtgaacaatgtcacagtaaatacaagggtatgatacaagtagacagtcgccagtaaacggaatggaactacacctcggtaacccagattaaccctgagatatatacaacttcttctgcagggtgcactattaagtctggacatactttcttgtacaatactgccatcattcagtccattaatacgcccccactagcacttactcaaccactcaacgctctctgttactggccaatacatgctaccgtacactaacgcaaccgcttagtgtatttccttagttgtcgcagtagtgaaaaggactactctgtgattctggaacctggccaacatccggcaacagcctgagaatgtggtatagagcacgatcctttagttggtatttgctatggtattgaacgagcgacagtatcattctggacccatcttggggacaggccgttctcagctggctcattgtatgtacaagtacgtcgctagatgaagtcctacccattttccagtagcccttctcaaacttatatccatccctatgcccgtgtttactcacatggccgtggtccccacactttctgctccagcaacctcgcgtaaagggtcagctgaaacaggtttatcgttagagtcgaaatgaagctcgtggattagaggtcgagacaaccatcacgcgtcgaagagaggctgaggtttggtccgaccccaccgttcctctgtcggctttcattctccaaccaatgtaaacttgacccgattcccaccacatgtcacgtgcagatcagtcctagcctctataacaagcatctggtgcttcctgtgaaatcttccctcgctatttgctctcacttgcccaccatccttgctcatcttgcctggtggaatgtacagtcggtacgcacttcaaggtttcattaaagcaggttaaaccacagctaaccttgtgtttaatgatgcggtgagaatgtgcaccaagtatacatgacgaatatctgaagtgccacaacggacctaacaatgtctggcgacaacaaaaaataggcagcacaaacgaggtcatcacgactgactaagcacactaatgacccttcagatacaaccccactcaagctcctccaaacactaatgcgccgtgcgtccccacagtactcaccaaagaggaatagttactggggtttgtaggtgtttgagctagagtcttacccctgggagagcttcgacggtgcgtctgctacagtacgagtacaagtgcgtctgctgcatagtgtctaaaagaaaacgacagatgaattgaccgccagcgcgagaacatgttttttatgttttttagtggatcggtccaatttcacaaagaatgacgtctgacacatgtcgccaagtgtgtctgctgcacctgcgatggggttagagaacaaggaacgacggacaagcgacctctcgtactcgtactcgaacatacaatgttccgaacacgcgcggaatctgtgcctcttttgtctctctctgttgtcagtcgtgtctcccatatgaccaaatctgagttgatagtgagcgacacctggagcttacgcttttcgagcttagtcgaaatacaggtttttctcgacacgctagactgagcttgtttcacagccagtgcggaatgtaataaagagccatcttgtgtggtcgagatagaggtacagtaaaatgcagaaaaagaaaaccgtcaacgaggtcgaaaagggcaatctgggcggaccccctcggaatagggccgggctgcagaagggtcggaaaaacggcttcttcttcggataattgatccgacagcttcctccagtgttcggtggtccctggagcagcacattgtgcagcccaagtgcacgtctgcagagttgtgctttccctatcggcttctttccggcacgcccaaggaaatacggctgctatataagttgaaatttggaaacagatgtggtgagatttcgcagcagtcgtcttttaatcagctccgttcattcaaccacagcattggtgcaattcgaagagccgtagggtctacagtatgtactgctcatctcttggatgtgccaccggaagcatcggactcaccaaactcacatcgataccaatgacaatctctgatcttgagtttgaacgttgagtatatcaggtgatgtcacacatgacggtaggcctattcggagaccacggctgcagtcgtctcggcttggggagtcggctggttgtttccaaaacatgttgggaccactgcatcgccatctacagctctgatcgcgtcccagatcgagaaaaggttccatttaacgaagcagagatatctcagcaaaaagacaacctcatggcttcctttacgcttccgttgcatttccacatagggctaattcggatggcttccaagggtgcgggagcccaaactatactggtgggccacctaggatggggaaagtagctacttctagtgcgagagacgcggctggagccgaggttggtgctaaactgagagaatcgaaattgaaatcaaatctcgaacgcgacttggcctttctgccgctgctctcgggccagaggccccccagcacacgccgttgtggtccttgtagttgctgcattcaggctctcccatcacacaatccaccatcccagcgtatcgaaaggcaaattaaatgccgcatgcgttggtgaaacagctgggaatacggtctcacggaagcacggcgactgaactgctgtgctggaggagaggtgctgaccgagtgctggtgtggatgtcttgtctgccagcctcgatctcacatctgtggcgtgcaccacgcatgtcgtatatactgttgcaatggcctggctcgtctcacggcttctgcagaaagtcgacctttggactagcaaacatgatattcaagactgcaccatagtggcacttgtatcctaactagtgcgttgaggaagacactgtgtagtctctgtctttgcacacccgggccgatagccgatgaggctcgctcgctctccctctctcgctctcgatggtggatgtgagccaacggcgaccggcgagtttggcgacacagcctcggcctcgtgtgccagcccaactcaactctacctgctttcatttatctgaacggtaaagggcgaaatgaaaaaagagcaaaacggaatacaacaaaaggtccggtcgctacttaccgcttaaagggctccttgcagccctcatgtgcacttgactttgcggtaaaagtttgcgcttgaaaacagagctacatgtgccaggtgctgggtaggggggtggcaatgtagcgtgccgagacgtgggtcggttctaatggcgtgcacgctccccgcggtgaccgcgtgtggatgtctgtgtgaccttcctttctctttcttccatttccatgcgaaaatcgtagctttatcagccgtcctatacctctttctggtgttacagtggttaaccttgagtgctcgacattgtctcttgtattttgtttgttttaaactcagcatgtcataaatagcgcacaaaaaaggtgttagcgacaggtcttagatacgagcgtgtggttgtgagtgtgaaggggctagccgcccgttcgacttatttttttggacgcaaaagcaacacacgcacatcctgcggaaacctgggaatctccccgtgccccccacggccacccagtcaccccatttatacccaccttactttgggtcaagaaaagatcgacagagttttgctctctcaaacttaccccgctgctttacgctaatttagattagcgcatgtgcagtcgagtcgagaccgtttggtctacgtcatgatcgtgacttgacttgtcgataattgcaccaccgtctcttgcaacacaaaacctcgcccatacctctcctggcgttagtcgtgccccgcacccgcagcatccatgaacgactttgaagacgaccagaaacataaggcaagaaccgagccctcgggccagccgcccaagaaacggtcaagagtcacattttcgtgtcttatttgccgtaaacgaaagatgaagtgcgaccgcaatctgccgtgctccacctgcaaggccgccaacgccgcccatctctgtcgctatgacatgaaccgcagcgcgtcgccccaggacagagacatgcccatccccagcgacgagtccatggtggcaccaacgagcgctcctggaggaggaagcgcggccaactcgggctccaagaagccccgtggccggcccaagaagtctgtcgccgagctcaccaagatgcaccagcaactgctggaacagaacgagctcaagggcgagaccaaagagctgaaggacgtggtcaagcaggagttccagtctcttcctccccagcaacagcaacacatcccccaacagcagcagcagcagcagcaccaacagcaacaaaccatgcgacatgtcccccagcaacagcaacagcacatgccccagcaagcacatcaacaacagcagttccacgcgctcaaccaacatcaacaccagcacctgcaacagcagcaccacgctcagcagcatcacaagcccaacggcctaaccatcaatacaaacgaccctgctacgcccgtcaaccaagcggtgcgaaaatcgtccgcagcctcagccactccgggcagaacgccccccaacgaaaactcgcctcgacgtggatcggccaagaaacacctgccgccgatcggagatacgccctcaccgtccatgtcgtcgccgtcctccgcattcaaatcgtcggctgacatgctgcaccaggtggtcacccggaccgccacagacaccaaatatattggcatttcgtcgaaattctcgctgtgcatgaagcccgcgcgccagcagttgtttggacccttctcgtccatgtccttcttttcggaaaacgagcacctgcagcggttctccaaacaggtgtacgaggccaagaaacaaaactacatcaaggacaagaacgcacctgtgcttatgcgccacaaaaacatatttaccgacttgccgcaaaagtaccgggtcggccgaggctcgtttgtaggggctggcagccattacggaggcaccagtgcgccgggaagcacaaacagccacgccaatggcggcggtgctttcaatgcggctgcgtcgcccatggacaagactccggcctccacctcgtcatcttgctcgaccatggactgtggagacatttccaagtctttcccatttgactcgccgaacggtatctacgaggtactggagctagtccctcccaagcccctgacgtactttctggtcgacaagtatatgaactcggtcaaccggttcttctacacggtcattcccaaatccttctacgagtgtctcgacgagtttttcatccagaagcagcgcattctgaaccgagagatccccgccactgtcaagactgtcgatctgcgacaggtggcccagattttgctgattctgcgtctggctcgaattacgctcccttttgactgggtggttcccgagtacctggtaggtggcaactctaacagcacaactggcggttcaaacaatgacggctcctccgcctcgtctcctcctgcctcggcagacacctcggacgtgtaccttggagccgggctttctcagattgccgaaaactgcctcaaccacatcggctatctgcgaaaggccaacctgcgggtactccaggtgctatgtttgctcaaaatcacggccatgtgcgatcccgacgccggcgactcggccgacggctgcgactcgtgcaacctcaccggtctgatcatccagatctcaatctctatggggctgcatatggaccccagccacttctccaaggtgtccccaaccattgctcatctgtggagaatgctgtttggtttcattgtcactctggacgcccatcgatccatggagctggctctgcctccctctctgcctctggagtgttcggataccgacattctgttcgagcgacactctctgcccgatgacctgctgtcacccggcgaggagcagcacatttaccatcgacgaaagcagctgcgatgggccttcatttctctagatgtggttcggggactgctgcgaacaacagtgcatgttactcccgatggaatgggcacctctccacaggccatgggcaaggagtacttcgatgccattgagcgcaagctggaagcatttgagaacgacatgaacccttactacgaggagatcctgtcggctctacaggcacccgagtcccgagacagcgactaccgcaccgtggacggccatgctgccgcccagcggctgtctctgtacatgacactagtgcgtctccgtcttggctactacctgtgtgccggcaactttatggacgccgccgaggtcaagaccaaggtggttacgtgtgctcttaagatgtgcgatatcatgcaggctgctatggagcgacctcatctcttctctgggttcatgtggtatgtgcatttcgtcaacctgcgaaacttcaccttctcgtttggtacttgcatttctgcatacctgaacgagatcaacactcgacgagccgagcgcgacatgcccatcattactcctgccgtcaaccgaaagtacaatgacatgacgtttgactattcgcccgacaagatccgagatcccaagcggttgattcaggctgccatcagaactcaccgatgggtccgatctctttcgcagcggtactatgttgcctggaagtgtcatgccgtcattgtcggtcttcttcgaggtgctcgtctggaggttctcgcccagtacattgacgctcaagagtacaagcggctggagaaggagggccaccgggacaacacgtttgtgggtccttacgcgcctcaaatgcgagagcccacaaccatgtcggttaccaaaaacgactggggtcgagacatcacgtcggagaactacgaccgagagcagagcgaacttcgagctgccgaggagcgtgccaaccgccaaggtcaaggcccggagtctatgtctgctcctgcagcgcagtctcaggaccagattggccagggcaaccagcagcagcagatggagtggcagggtgacaacaacatgtttcagaacaacggtctgatggagcctccctttctagaggacccgatcattgacgaccccacctttgataccctgggctcgactctggggcttccgtcgcttattgccgaagagtgggccaacattgaggactcgctctttgatgatcttaactcgtcgcggttctacatgtccatggaccagaattttaacaacacctccaccgccactgacaactatgaggtaacttcgccctccagatagtcggattcttctagttgattggtggttatttatttgtacagtaatgtgataatagacaattgaacatgttattgtattgtatacacttgtagctactgtagtgtagaaactgacgatcactgtttcgtaatagactacgttttaagcagtcagttattgatgatgggtacttccaaagaggtatagtaatggacctcattaattggtggttaagagaaatcaaatgcctcattattcaagtgcagcacccactgatagccaagacattgaagctattaatcgtcatgtaaaccctggcgtgaaaggctctccagccccccggctatcgatacatgtccgttaaaatccgtccttgtatttagtttcattttatcgacgacatttgcgcgcatgcgctatctaaaggctacaagcacagtatatacgagtacaagcagctgcaatccagtatacagtcggcacaaccttcacgtgtgagcgggctgaaccggtggagacagctgctgaaaagtggagcgagtgcagagactttggccgccggtggcgatagtgaattatgtgcagctacactgtgtgcacggcccgtacggggagaccgtataccttgcctgtgagcgatttacacatgcagtgagataacactggcggaagtacgagctgtatggaagacaagctaactggtagctaccagtacgtagtacgagtacttgtagcgattagctgaaacagccaagtgaattgaagtaaaaccacgtgtcaaacaaccccctggtcaaacagttttacccccacgtttccaacacatcttatacagaaagctcaaagttgcacgttccggacgagccgatgcacgttaatcggccaatggtgatccagagccgtggacgtttgggttgtgtggagatgtcagctggggatggaagtgagcttgtgccatgagcttgataattgtgcaatgcgtggtttacgacggttcggtagttatcgactaattgggcggttgccgttggactgatctagtggttggtgataatcaaggtagtcatgtcaagatgagaaaatttttggaagtgcaggtagaaagggcaagctcgattgtacatgatgtaatcgttcaatggcttgtcgaaccaacgagcccactgtacagccaacagctacctcacatctgttcactcgccagcctcttgtacagtccttacctcatacaagcaccatatacgtgtagacatgctacaagcacggaacaaaagaggcaatcagtggtatcctgtataaggacaggtacagtatacaggcacagtgagtatcctttatcattacagtatatacagtacaaataccatagatgtttacgatccataagaagctatgccgttgcatctcacaccgtatgttttttatcctccctttcggtatcttccccgaagtcgacttttgtatatgccgaagaaacccagaacacgacagttccttgtcctctgcttcctttttcattccaccgatccctgaccctatctcttccctccttcccctgaaagctacagttgtcatgtatctctgtaacacctatatatagatgccgtaacagtctgccgaaatacgaacgtttcacagcttgacattacgagcctcactcctaccacagtttcattttcattttcaatgttccattcccataaatatctatatatccttgacgtgtacacatcatgccgagacttcctatctcaatccttctcttctctccttcttaattgtcctcatccttcattatgctgattccaataactaactgcttcgggttttgggagcaagccattcgtcggtgtcgaaccatcgcttcttgtgctgtgtgttggcttggtccgagtggtgttccacggtgggcatggggctaggagtggctcggctcttggccgaagcggcgtaccatccaagagcagaagggtagggcgcaggaggagccatgttggtggcagagcctcgagagtacgaccaaccaggagtatcggtggaagtacatttgggaggaggtgcaaagctcaggaaaggtgtgtagctggaggtggggaaccgctgagacatgctcttagcggtgatggtagagccaggctgcatctgcatgggagcgtacttgatggttccggattgctcgccgtagggcacggtatgggaggccatcaggtcaccctgggccttctcagacaagtcggaaatttgcttagcagggggttgtccggggtcttcttgaagagccttggtggcgccagaaaggccggtcatctcaaaccagttggtgtagtggatggtgtaacctccgttggccagcaacgcgtacagctgaatggtgtagtaaccgtttccgccggcagaggcagggatagtaaccgacaccgagtcggagtcgggagtaataccgtccttgagcttgagaccctgcgggttgaggtctgtgttactggttccggtgaccagggtcactgtgatgcccttgaggtcgtccagaggcggcttgtctccgtcgtcttcccacgacactttgatagtgtcaccggccttgaaagactggccgagtttaggagatgtgatggagatgtcggcgacgacaaaagtcgccagccagagcagcacgagctggggcagaaggtgcagcattatggattagttgtgtgtgttcttggtcgttgttttccgtgatgttaagagtggtttatgatcgtgtcacaagaggtgtctgtgagctgagatctatttttggaaacggcgacggaatactagcgagcgtggaggccgtggtcgtgtcgaggtcgagagcagtgttggacgagcaagctgagggtcggagtagcttggttcaccgcggattcgaaaaaaaaaaacggtcgttgctgatacaatacaagaacaagtagacgtctattttcaagtttgcattttctggctttgctaagttgacgaggcggtgtccagaactttaaaaccacattagagtttctggtccgaaaccagaagggctctttggtgtaggtatcgtagcaatgaggagtttggggtgatcgagcggggatttgagaaggcaccacccaagttcgtggtcacgtgattaatccagcgactttcccgcctctttttggtccccgaaacaccctcttcggcccccttgagaaaatgtcacagtacgctgcaacatgcgcataaatccacctgttcacattacatgaactattgcttggctacccttttggtaagcaatgagctaaccgagagacacggaagagggaggggggtcctttttagagccgctaaaataaatggcgcgctggtaaagtgtccacttttggtctttatggagcaatggcacgtgctctgatatagatccattgcaattctgcgatccagcggacgtgccatacatcaattccatatctcgatcacctcgcaagtcactctatttacacatggaatgtgtgtttaaattctggaaaaaacaggcccacaggctgagttggaaaaacagggataagcaaacaaggttggctggctctcccaacacagcaaatatgagtggatgtcagacacagtggaatgagaaaacagcatacagcctacatggtcaggggtttgaggtgatatggaagaagatcagagatactcccggaggatttgacagtaccctataagcaagctgttcacgtcatctaccctcgcgcctatatacaaccccaactattggttgttgacatggcttcacaagctccgaactgtatttacgcactgcgagattcgtgtaaaatgaaatgcgcttgtactaacgtgatctacgcgtggcgcggggtttggtcgagctgaggattgattggcgctggattccgaggctgtatttcaagtcacgtgggctgagagagaacgaggcgagataactgaagcagaaacactacaagtacagtacttgtagttagtgtctggcgtttcccttcgtactgaaaacacttacacaccctacaatgacatcatgatcaccaagagtgattggttccgtggagatttagatatttgagatgcaagagtgtcgtcggctccggtggcttagctgcgctacaggtactgtacatactgtactcgtacttgtaccagcttgacatagctggcacgttccagtatatgatagtggaaccacttgttaggtatattggttgaattttagtaagcgggatcaattcagctgaccaattggtactcaatgtattttacagcctatctccagcatgtctggaacccatgctgtatcatactccttcatgtttctgatctctacaatactgtaacaaagttccactttttttggccaactcttttcccaaattcttagcatacatctcacttatggatctcatccccatttaagtgacaaacccacaatctcaacaggcaattatattcaataggcgctttatattattaatacctggaaaaaacacacgtgacctaatcctcttccagggctccgctaattgtcgccctccttagtcatatgctctgctcatacacactgtcatttaaggtttcgagaatccaacttttcacccagatttcaacatctcagttaggatctaacacaactacacacaacctcactcaccatgttgtacctcaagtctctgatcaactgcatcgacaactctggtgctctgctggtcgagtgcatcaaggtgctgcgaaagtcacccaagaactacgccggtgtcggcgacaagattgtttgtgtcgtcaagcgggcccgacccattcctaacggctcttccatcacccagaaggcccgaaagggtgaaatcaagcgggctgtcattgtgcgaaccaagaaggagatccgacgacccgacggctcctacatccagtttgatgacaacgcctgtgtgctgatcaacgacgccaacgagcccgtgggtaaccgactcaacggagtcgttgccaaggaggtgcgagagcgaggcttcaccaaggtcgcttctctagctccccgagtcttgtaatctgtgcttaccgtacccgtaccgtaaccatggcttgtatatagtatttaaatgtttggtattcacaagctgtagtgtgggatgggtagcttggaaacaaggagtggttgtagtgcgagtacaagtaagcccaagaaagtaatttatcaatgattatagataatgaatgaatgttgtcacagatgtagttacagcactcgtacgaatacttgtaccgtatgtacttgttctgtggggatagagcttgcctccatcgctcttacttcatcactatcttacttcgtcactattgtactccatcatagattcagccatccagaaataacatgtcaaagtgctatttcgagataaggagcaactcttgtttgtatcaacttgaggttccgttctagaagacggtctttgatcaagtagagaatcccatagctatcgtcgtatgccctcaaaatgtcatctccaccccataccaaccaacgtcagacctcctccattttatgagacaaagtctcacacgcccttcccaatcccctgtgttacagctcaacttggtctccgccacctatccctccaccgcctacgcctccacacagatgctcacgtcaaaacataaataatccattaacgaaccaataatatacaaccctcgaataatcccctctaagaccggaaaatgttgttgcagttgttgcagacaaaaaacagaatcatggtggtctccgcacgcttctgttgcgactggaagaagaccacatcgtgctcgtgacacttgggacactccttgtcggatcgaggcagagtgggatctgctccaataccggttgtcactccggccgtctcctcaatgttggtgatcagctgatgcttgaacaccagaggagtggatgcaaactccgtgtacggacagtttcggcatgcaaacagcagctttctatcctccttatcctctctcggatagagcatgttgttgctgggttagcgctggtcctcgatcattctcgtcctctcgttctcttgttctctctgatcactcaccactcgagacaaaatcgcgacgtcattttggttccgtcttgttccacacactgagctgtcgtctgctgtgtgtttttcaaagcccagtgaagatggtgttctgcagctctatggcaaactctaaatgtgcgcacgagtctattcttcccgtctctaatccctccctctgactacaagtatagtgattgggaggtttgggacaccacagtacaagagcaaggccgggtaaccctccgtcacgcaccctgaaaatttgaaaactcacctacagcagcgtctacactgagtccatctcaaccccatacaaccgcacaatgtctgctcttcgaatgtctcttcgagttgctcgagtcgcccgtgtggctcgagttggtgttcggtgagtattaattgcgagattcactccttgattgtttttctcgacattgaaatcaagccagatcaccagccagatcatgtcatcaactcacaaaagcactgatctgaagacgaaacgcttcaaaaaaacccacccagctccaactaacacagattcaactccaccgccgcccccgtggaccccaagatcaccgctattgtcgaccagattgcccagctcaacctgctggaaacctcgtctctggtgaccgagctcaagagccgactcaacattcccgatatctctttccccgccgccggagccgcccccgccgctgcacctgccgctgctgccgaggaggccgcccccgagcccgtcgaggagaagaccatcttcaacatcaagctggagtcatacgatgccaaggccaagcctaaggtgatcaaggagatcaagaccctgctcggtctgtctctggtcgacgccaagaagattgttgacgccgcccccaagatggtcaaggagtccgtccccaaggaggatgccgacaagatcaaaaaggtgcttgaggatctcggcgccaagattactcttgagtaagtgtatatagtaactcattttgaaccagacaaaatacgagtgcgaaccacgagtattggatgctcttctggctggagaactggaacgtagttggagtagtagtagtcgttgttgcccttatggtacggctgtgatacgacagagtactttcaagatgtaaagcatgaaatacgacgaaggaaatgtttgcttgactgtttagatatgttgacaatatcaatagcctttcggataatcagatatcggtactgaagcagtgtgatttccttgacctaatcacttactcatatgttacgttgatgacatgatctgaatgccaatgggcaacagtttcatatcttccagctgaaacatctcaattgcatctacaaccgtctataatcaccaggtggttgtacattactaataaattattctacatgttggtatgaacgccgtcattggatagctacggctaggcataccagagtcccgtttttttatcacctcttgatctcgttttaagcacccactactccttcgttaaaagtctgggctcatgctcatgctcttctgccgtctattgtgggcagcaaggcgtctagcgtagctaggagttccgagttctgagggcgtggctggagtaacagatctcaacgacgacgaccggggcatccggggagtggtcggatgttgtggggggggctgcacgaattgaggagcatactgctgttgttgagacggcggtatctgttgttgggtgtagggactctggtaggggctgctagagctgtatccctgaggactaacaacaccaatgacacttcttcggttggttctcttgatggcatggatctctagtttcttctcgaggatcttgacgaaggaggaaagagccactaaattgtttgagatgccttctgagaggccagattggcctggtaagtggcacagggcagtcatctcctcgtacatggtatacaaggactcgtagagatctgcatccaaattcttcaatcggttcagcgacatttcaatgtcaatcatgtcctccgagtgatcaaagttggacatagtggactgcccagtgtgttgagtttgcagaggttgttgtatatgggctctctgatgctccatttccgactctatggactcgcacgattcgctggactcgtttgatgcaaacgacgtgtctccatctgctctggagactccctcctgttccgtttcggtgcctgccgagtcttcggagttctcatcatctccctccatctcagactccatgttgagacgtctgatacgttctctgagagctcctaacgccgaccacgccgaagagggaggctcaatagtctcgggctccaaatcacgcacgtcccgcaacgtggacgagcgatgatggctcttgtacgctggcttaccacctgcaggggaccccgatccaagaccgcccatgtatccgttgttgaaggctggaaatgagttgacgctggtcgagtgggtatgcgacgtgtgtggacgacctgctgtctgtggtctgtgcccgtgagatgtgtttggacgtggtgctcctccaccatacagagatgagcttctggaccgcgacatttgggtgtttgcgaacgggttttcttcgcggtcacctgaacggctgccgcgtcggttggttttgtaggggaacatgtcaggcctagtcgagagttatgtctgtggctgggtatcggtgtctgtctcttaatggcttaccgtggtggaacgttgagtcagagttggtgtatgcaatgtatatcgttgagttgttagtcgttgagtagtttgtttctcacggactgtctgtgtcgtatctcctctcaattggcaaatccacttctgttagactggtgaccgtctagatcaaacctggccatcaacgcgtctttcctgtaatcgtgtgtgttaaagttgatgttggcacctgcaggctgtttcacagcatgtagtcagggtctattcaactgtccaaatatcgactttctcagaaaatatttgcatcccaggtatctggacgcggtgtgttgttgaatacatcttgttcaaacgccattaagtgcacagagacaccacgggtcgcctaatgacgcccataacctcctggactcacccttacaacttaaaaacacttgtgaaggagtgttctaatttgggttaagtaaacgttataacagaatacttgagaagtacttgaacttattgctacgtaaacgatccttaaaactgctccaaaaatcaaagaaaaagcatgtggaaaaaaaaaacatagatattttggtccactttcaacatttccaagtatattcctacccttcacttcgttcctacatccaccttaaagccccctcaatatcaccaccacttcctatatgtaaccttaaatctcttaccctacctgttttcatcaccaaatttcctaaccaaaatactgcttgaaaccgcacctgatctgacatattcagaccacacaactagcaaaatgtcgtccaaacagttggcaaaaaacctccgtcagacctaccagaacatgactggagtcgacaagcagattttccagctcaacaaggtcgtcaccgctcctggagcatacaagctgcccgacaatgtctcggctctgaagctccgtttcaaggactctggtaaccggtctcagaccaagctgttctggacccattcgctgcccactctgcagttctggaacccctccgtcgccatgagtgtgtctcgagtccaggctcctaaggagaagtccgttggacctaccgtgaccatcactcgaactgatggctccgaggaaaccatttctatcgcctccatgttctgggagaaaatggccgagaccattgctgaggctgccggagcaacccccgtctccgccggcgagctcaagaagtactccatcccctttgtcaccgactacgacaagaagatggagctggccaagaagacccatctgcgagatgtggcctttgcacagaaggtggagctgcacaagcagcaggaggcagaccgagaggccctggagctggcggccaaggaagaggccaaggccgctgcccagaagaagaaggacgccatgatcaaggcccgaaaggagggacgagtttacattgagggagaggagaacgaagttaaggaggctgctgtcgaggttgagcagaaggtgaccgaggaggtggccgaagatggagccaagatcgagatcaaggagaccgaggtcaagatcgagaccaagaactagaaagagtaaatatgtggatctctcgtgaacagtaatggcacgtgagacggtatatagttccattacatgatttattatgacacacccataggtgtgagcgtcgcgagtgattgtacacatacgggtactacttgtagctacaagtacagctgttggcacttgtacatactacactattgtcagcctaacataatgccaaggggggggggtcgctaatgccaatagtacagcattttggagttcgtgggtaattagaggtgctggggattccgagtggtttatgtatcgttacgatatgttctttattgctgtttgaagggggaacagttcaggttcttgaagggggtacaagcaagtacatcatcatacttgagcggtaaatttgggcctcggtatgtagtaattagggcattggaaagatcctgttaactcgggtttacattgccaatgtgcacaaatcctttgcattttccaacaagtaatttatatgaaaatgtctccattatttccgtcactctttcaaccactttcagctctgcagaaatgatgcagcttaatctgggttcgaaaaattattttggattaattatttcaaactgatttcacaccccagttaccgacttaaacacacacacaatgtcgttcatgttccaggttgacggatggaatctgtccaacgatgtcaaggctgataagttgaccaagcgtcagaaggaaaaacgagaccagcaggccgagcgaggcgtcatgatgcgggagaagcgagagcagcgagagaaggagcgagctgatgacgagaaggccgccgaggctgatgccaaggccaaggctgaggccgctaaagctgctgagaaggcttctgctgctgaggatgctgctgattctggcaagaacaaaaagagcaagaaggacaagaagaaggataagaaggataagaaggccaaggcttctgagactgaagaggcttccaagccagctgctcctcctgctgaagcgttcacacaggctcctgccgccaagctgacacctcttcagctcaagatgaaagagaagctggccggatcgcggttccgatggatcaacgagcagctgtatactgttccctccgaagaggctctcaaaatgattaccgacaaccccgagatttttgacgagtatcatgctggattccgaaaccaggtgcagggttggcccgagaaccccgtggacacctttgtcaagcggtttaccgagaggctcaacaagcctgtgtgttctcctggagggctgcctgctcacaagcgcgagaacaagattgtggtggccgatatgggctgtggagaggcgcagctggcgctggatctgagcaagatcaacttcaagaagaagggcgtcaacccccagaacaagaacctggtggtcgagacccagtcgtttgatctgaagaaggccaacgagcgagtgacagtggcagatgtgaagaatgtgcccatggaagacaactccgctgacattgtcgtcttctgtctggctcttatgggaaccaacttcctggacttcatcaaggaggccatgcgaattctgcggcccaatggagagctgtggatcgccgagattaagtctcgattcaccgacggccagaccgacgagttcatcaaggtgctcaagagcctcagcttcttccacaagctcacagacgacgaaaacacgcactttgtgcggttcgagttcttcaaacccacccaagagattctcgcccaacgaaagaagaaggtgccaaagcgaaagttcattgactatggagatgaggaggaaaagaagggacccgaggacggcgagcagctcgagaagagacgaaagaagcaggctgagggcgagtggttgctcaagccttgcatttacaagcgacgatagagagacagtacaagtaccggtagcttgatggctgtcagttaactatatataacaaaaaccagaacagtggtaaactactataatagatttgtataagtaatactttttgtatcatcatcatcctcctcatcctcataataatcatcatcatagtcactctattattgaaactattgttttctaggaacttttagacctgcaagtgtgtcttaagtggttgacagaatggtgttgatcatctcgttgccaattcgagtggcttcagggaacatgtgagcaaagtatttttgggtgtcgttgaactcctgctcgtacagtttgtaggagccgtaagaaacgaccttagaccacgttcgagcagccaccacaaactccagatcgtcgggtcggaagtcctggttagtaatggagtgtttgatgcactgttcgagcagtcctggagtgcaaaagacgtattcagtgacacccagccagattcggaacagaggtgtcgagcagatgacgtggtcgtaggggttgatcttgagtttgtgccacgagtcgacaatggacagcagtgacagatgcgagttcggcttttgtgtttctcccaggggtttggttccgagcgaaaacttttcgagaatctcatcggacagcagcagcgagtgttccttcttgaggcctccaaacacaaagtctcgggcagccgtaaggcggtcaagcaactcctgctccttgcctgtgatcatgagtttgtacagatcgccggcactggatgcgtactgctggatctgaaccttggcagcggggtttgagatggccagaccggcatagacgtgccatttattggagtagattcgcagcgagatgttcatctttgcgttttccagacctccgatccaacggcttatctgccaggggtactgtccgttcgcctgccaggccttgcccatggtcagaaatgcggcgtgagtcacagcctgtgtgtcggcagtgattttgtcgtgttgctctgccgacaggtagacaatcttggacttgagtgactccagcagtgactgcacaaactcgaacttccactcctcggtgtttctgtgtcggataatcaccagaggcatgccctcggggttgactttggggccgtgtagtgagtggcacgagatgatatccacgtcagagggcagatgtgcctcgaacgcagccatctcgggagccttacaggacgtttgaccacctacaatggaaccgacctttgtagagggaccgtagatgctgacaatcttgccgatattctcggcctcgacgcagtagagaatgtaatcgcactttcgagacacatagtggccattctggacgatttcaatctccgaatcggcaaattcctccttgagcttctcatagtgggattcctgatcacaggccagcactttccagccctgagagttccagtggttagcaaacagacggcccatgtcgcccatgccaatcacacccactagcttggttttcttccattcctcaatagacatgttgtagagcgtggcgaaagtacaatgtatcgtgtcgtagaaatggtgtttccggatctccatattgagactaaaaccttatgcggatagtgaaactccgaggtggaatggaggtgaaggtatagggggcttaaaacgtggtattttagaactgaatttttaatttctggatcttgaattggttgtgattgaaatttgacatttctatttctcataacatatcttttacccctgtcattgtcgagtttgtactttcctaaaatcattaacaaacttttagcttatgctgaagtatattcaactaaacggaccaccttgaacttccatctaccacggtgatctgattcggaagaaactgaaacataagccgaggggttgactggtctttttttgtatgtaaattacctgttgttattcaaactcctttacccagttacccactacatttgttctcctacttctcatgtcactccaaacacacgcgcaactctatttgcacatccgacatacgtggtacagctctccatacccacacccggaggatagacgtggttacacagcaagagagatgtacgacgaatgggcatacatggacgcggcgaagccggctccaaagccggtaagcccgaagagatcacgtgccaaaagcatcattcagtccgtggccgtggagaaggtggtccaagtgacccagacagatgtgctggaggtgcctcctttgcgtcgacggacacagagcgtcaatgtgggctcgctggagagacccgaggttgagaaactgcgcacagaatggccattctcgaggagagaagtggaagagctcttttctccttccggaaacagctccctacaacaatcagcatcgtcatcacaagaaacaaacacgccacagctccaaagggccaccaccatgtacatgcaggccacgtcgtactcgctgacgtgctccaagctgctggaccagactaacgacatcattggcttgttggacactctgtccgtttcattcctcaaggtggaaaacgacacggagaagttccaacgcgaatgcaatgcgctcatggacgaacagacacatttggaaactctcatcggtaatctgcaacagaatctcgacatgttcacccgcattgaatctgtccagagacaggtgacaggaggcagtcacaacttcatcaagacgccagcgtttagatccattctgcagcagattgacgagtcgcttgtctatatccccgagcacaacaacttcaagggtgctgaggattatgagcagcgcttcatggcacttttagtgcgatgtttacgtctggtggtggtgtatttcggcaacaaggtgacggatattggcgcagaggcacaggaaaagatggctaccgtttcttcgtcggcagccagtcatgctctcatgtacagcaagtttgagcaggccactaacctgggagaaatggtgtctgaggtgtcaaagcgagctcagtatccacagattgagcccatgatgcaggagctataccaaaagtattttgcagcccgtcaaccaatcctgcgacctcacattgataaatctgtgtttgacattaactcctccagtggcacagacagcgtcaaattctgtcggaaggcgctgtcgttgtacaagcagattttcagcgacgagaagcggctctttgaccatttcttccccgacgagggccatggtcgacttgctgaatggatggatggactgtttgagggtctgtatgaccagcttcgaactcgaatacttcgagatcggtctgtttctgtcttgtgtgagattgccgtcatcctgcaggacgatgagagtatggatgacgatggctttggcaacctggttttcaacgcactacaagacgtccagtcacggttggtgttcagggcccaaaatatcattgatcatgagattgttaactacgttcctggagacggagacttcttgattggtagcagaaggaccaatgaaaaagaagatgataagacagcttcttcttctgttggcgacgaatctaacgccgatatctccaatgatctccttcagggctggtaccctcctctacgacgaactgtgattttactgtcgcaaatataccagttggtcaactcgcatgtttttgataccatggctcacaatgtgttgcacgactgtatcacttcgttgaatgttgcacgtgtggtggctcagaagcgcctgggtccgtctgacgccgagctctggtttatcaagaacctgttgatgctcaactcacaggtggctgagtttgacattcagtttgtgcctgaggagaagcagcttgacttctcgggagctctgggcattctgggccagattgcgcgtgagcgacgtgtgaccaccgacaaggatggcattgctggtcttgcacgagcctctctgcctcgagtcattaactccatgatggacgctcgtgtggaactttctgccaacctgcgtaacgccatctccaccatgaccgagtctgaggtgcgccacattgccaagagcatcatgacggaccccaaaccggagaacattgtgactgacacgcggcaactgcgagaagacacggcctcagagattccgcggtcgtacacgaagattaagtcgtatgtggacgatgcccaggctgcggatgtgctgattgaggccatccaggacttgttggtgcgcaactacgacgagtatcatcgtaagatggtcactcggggcaagcctgagcagctggaggctcttatggaggtggatggattcgtcagttgggttggagacgttattcaaaagttgtatattagtgagcaataagttaaagggtggacatgtaaatacgactgaacgcatgatgaaggaattacatggagagtgggggagacttgtagagagtcggtagaaaaaagaccacataaaatagaccaccagttactacgggtgtgtattcgttgtaaactacagtagacagctgcaatacacagtatcattgtcgcgtattgtacaacaggccacatttatgacagtattactgcaaggcagtgtgtagagtaggaacggtccatccactttctctgcaattttattgaataaataatccgtcgactgtctactttccagtcgctttggcagcctcctcgttggggttgtatgtgttttcggccagcatcttgttgagcttctgtttgaccacctcgaccatggaggggtggatcatgagatgggtgtcatccagctcgtccaaaatgatgttgtgttgcgacgagtcaatgttgacgatgagcgccttgatggagggatcgcattcaatcagaacgcctgcgttagttgtctgctcaccggctggttttttccgctgtcgaattctccctactcacctctggtggcctttggcatgttgatgaagcgaactttgattgggatcagagttgtgatgaaaataggtgtaatgatcagttagaggttctgatagaaatcgatgtgatatatataaaacccttttaaaccactaaaatcaaaagagatggtaatttgataacttcccctttagtgggaagttgccccactttttcaatttcacctaccgtggcgtgtattttcgtacacttggtactcgttcttagaaacaactttcagactcagaaaaagaactgttacaggtttacatgcacctataaatatgacatgagacagcaggggtgttgtcgttatacagtgttacggcagtgctcatctgtgattgtgattgtcgtcgcattctacaagtagtcacatgagtacgtacaatacacggtctttttggtattgctgtagcttctactactacaccttgccgtagtttaaccgtcccaactaaaacacactcggtagttaaacaatacatacgctacagagatacaatagaatccccgctgtacaagtactatacggaactggtgcgcgttcgacgtccaaaaaagtaattcttgacacaagcacgtcgctgccaagtgtcggctggttccaaacgtacaaatatacacctgtatgtacgaagacgtcatagctctggacgaggaaggggtaacagcgaatgtctttaaatcagcaggtagaagttctaacagaataataactataccattcgatttgtctcgtctcggtggtcattatacacttttcagatcttgaactgttccatttttaccactttcacctcctgacaccctggactcgactcccgggtaacccgcatatatcacagcctacataatcatgcagacatcctctccagtcaagatgccagacgacaatgctatggagggagctgaaactcaacatgaaggtggcaatgtggagaatccgccgacgggtgaggaggtgattccccagtcacgtggctccgactacaacaccgctcgagatacggccgatacgagtactactactgccaacaacgaagtcgatgaagcaactgagacgaacggaaacgacacaagcaatggttctggcgacaatagctcgggtaagaaggatacggaaggacatagtgatgacaacgaagctcagaatggagaaggatctgataagcatggacaggaggatacgcaggaggaagaaggcaatgatgaacagaatggcaaacagaatgatgaccataagtctgatcacaactcggaatccaccaactccgagtctgagtctgactcagactccggctccgattctgagtccgattctgactctgatactgaagaagctgaaccacgactcaagtactctcgtttggcaggtcttcccaaaactatctttacgcgcgaccccgtgtctgccacgttggtcaacgataatattgtgattatcgccacccactcgggtctcatccatctgttcagacccaacattgagttgatccgcagcttcaaggcccactcggcaagtatcatgtctctgagcacagacggcacgtactttgcctcggcgtccctagatggccgcgtagtcatcggcagcatttcagatccccaagacattgctgcatccgacttcaaacgaccagttcatgctgtagccctagacccaaactacgcctcatcaaagacatttgtgtctggtggaaccgccggaaacgtggtcttatcggaaaagggatggctgcaggctcgaagcgacaccaatatttgcaccagcgactcgacaatcgtgctgctgaggtggattggcgacgtagtgctgtggatcaacgacgacggaatcacgatatggaaccacgtgactaaacaacaggttcttcaggtgcccaaacctgacaacatttcgcgggccgatctgtaccatccccgcatgcatctcagtgatggacacgatcgaatctacctcgcttgggcagaccacatttggattctggaggtgacgcaggagaagaaggaacgcggtaagagactcaagaaggagcctgtcaacgacggcatgtcaatattctcgcgccgaatcctttcaacctctgcgtcttccacgaaatcaccccagccagaaacaacagttgctgtggtgaccaagttcagagtcgattctctcctgtgtggcatttcgacctttggagccgacatgctcatgttgctgtgttacaccaaaggagagcgacgggcccagagacccgagttgcggctcattgatgctgcttcaggtgaagaagtgtcttctgatgagctgcctctcaacggctttgaatctttgggtcccaatgactaccagctgcagacccacgcacctgtgcagaaagatgccaaagcacagtactacattatcagtgcgcacgacggagtagttgctcgtgagcgagatctcaccgatcacgtgcaatggcttgttgagcacgaaaagtacgagtctgcctgggtcacgtgtgagtccatctacggtactgtggagcgaaagaatctcggcattgaatgggttgagtctcacgtaagagatgaactttggcgagaagctggagcggctctttctcttgttctgactgcatttctgggtacaattgaccctcaggatacttacaaacacacaatttggtcggaggactgggcaaactgggctttcatctttggaaagtcaaacaactacgagcttttggcaaactatctccctgaccagcttcagtcttcggtctacgacgagtacctgcgtcattatctacgcgatgatgctgaaaagtttggtttctacatgaaaaagtggcagggtctgttcggcgaaggaatcgagcagtctcttgttgaagagattgattcctctgaagatgacaagaagaccagtgcgctgaagctggctcttgctgagctcaacattgccgacggaaagtataagcctgctctggcgctattgctggagttgcgagatgaacggtgtcttgatctaattgaagctcatcatctcctgagcgatatttcacccaaggatatccccagcctgctgaccattggagctggtaaagacacagcatctactcttgctgcccttgacaaagcatctgctgaggagattcagacgactctgaaacgcaccactgagctgctcgtggaaggttaccatgagttgcctcccaaaactgttctttcttctctccctgagtcttctcccctggcatacgtgtacctgcactctctgaaccaagtagattcgtttgctgctcgtgactatggtaaccagctcatggctctgtatgcgaagtacgaccatgtggctctttctgccttcctcaagtccaacaataactacgacattggttctgccgttgacctgtgtcgcgcagacaagagtctgactccggacttggtatacttgcttggaaaggttggccgcaacatggaggccttgcggctgattattgacgagctgcaggacccttaccaggccatttccttttctcttaagcagaaggattccgagctgtggaacttcctggtcgactactccatcgacaagcccttgtttctcaaggcgcttttggagaacatcgccatggcacagactcccacatacaagctcattgagcggatcccccctaacctcgagatccctggactcaagggctgtcttctgaacattttcaccgagaacgagctgcagctgtctgtgactaaaggagctcatgagatcatcaccaatgagtgtcatcgagaaacagacgctcttggtcggttgagaatgggcggagtggcgtttgatggagtaggtatggacgagtttgctgtaaaaagtcttgacgggaaaactgtggaggtggatagcttgccttcttggcaggcgcatgatgggtctttcgcatccaagctggcacatgtttcgtttctccaacagcagtcaggcaggtaaggtggaaatatacaataatttattcattaacatagatattgcagtatgtagtataatgtagttttgtttcattcgttgttcgatcactttttgttgttcgcctttgccaagcggtcattattccacagacccacaaacgagatgcaccagttcactactatccagatgagcagtactccgacgttcaagccaattgtagacttgacgttgaacagaatcgttcggatggcctccaatgcattgtacagtggcatggcttttccataagcgtacactccaggcgacacttccagaggagacatggcagtggcagtattgacaatgacccagaagagcagccagacaggcaagattgggggaaagtacttgacgaagatgatttgaatgttgtccgtggctcctcctagtgctaacatagccaggtagttgatgagccagtagactacgaagcctgcttttccgtaggcgacttcaaagtcctgttggaaggccagagacacgagcgagaagcacagcgacacaataaacatactgacgcagttgacggcgcatctgtacagaaatctctgccagaagacgatcttgtaagggatcattatggcgtggatgagattccacatcattgtttgttggaatgatacaatgatgagatagatgagtcccacattgtctatagccgatgctactcctcctgtaaatggcctgatgtcgtagtttgcaaacttcagtgttgtgatgttgtttctgatgatgtttgcaacctgcaaatctgagaagttcctcgtcagcagctgttgaatatgagggacctgtttctccaaaaactgggcctgaaactctagaatctggggaagaatgtaggtccaatgaattgtttcctgtcttcctgatgcatagtagtatgatatttggtgtgcctccttcatgtctccatttagtatcgcctgggtgtcctcggtcgcattatgttccaccaccagcactccccaatagttgtgctgtaccaccagagtttcgatctgctccctagtgctgaacatgtctgagggaatgtaatccagcgctaccagagtcttttcttgaggtctagcacccacttggtccatgaacaagtctccgaccaccccctgatcccagttgattacccccacccgtaggttatgagccctctccgatctgcggaacatggcgccccagaagacggaaaagacagccagcactccgacactcaaaaagagcatcatgaacagtgacttttttaacacggcatagtgtccgggacgcacatcattgtggaagaggtgtcgttgctgctgctgtgaaggctgtatgtcttgctcagagttgtccgacgattgaataggctgtttttccgaagccgacatgctctgtcttttgtgattattcgccaggcatgcgtatatatatgacagcggaacaactaaatatggctgtcatccctgtgtcttggactgacgtactatcggccgaggctgacaaatgaagtgtggagaaggttgcattatcggagtagggacccgggttttgttttaaagcctttctaggagaaaggtggctaccgttcgatagccgagtagctgggtgtgtacagactgggcctgtactggtacgagtacgagcacgagtacgtcataagcaggtacgcaatattgtggcttagacagccagcgacgccaccactcgcttctacaatgtactgtcactaatagtatgctagtggttccgcacgtgatgaatgacagttgctgtgacctgttggtggtggattttggtacatacaatctcattcaagggtattttccagacctgaaatatttcattgtcaactgtagctgaataattacgtactcacacaatcacccaggaagctcagttgtgtaggtgccgtaacgcacgtgcgatacaggaaaaaagacgctctccacacaagcattatgggagcgagtaggagcagatgttctaaggcgatgaccacagactcccaggtatataaaactcgtaattctgaaagaaataccaaatggctaattctctgtctctcttctgtccatacttgtcctggcagtccgttactacaagcactcactgtacgagtatgtagatactctctacacctccttctctatctgttgcctattgcacgtcacgttggcaactttcacagctatctgacagcccccagcctacagtcatacccgtcggtattatctctcacgtcattagcaaccatcacggcactgagttgtctccgcctcggattctaagacactcatcgtatgtggggaaaggaagcttccagtgtcgatctccgaaacgttgtgtagacgtttgcgaatgctcgtatagaggagagaatgcttgaagggtgcccttctgatgagaatagccagcatgtgtagagggtccgcgtaaccggttgaatctccatactaaaagcccttagttaacaatcacagctcagatcacagttcgcatagtcgactgtacctacttcactacttgtacaatattcaactcaagaaaaacgctaaaaaactgtacagtgctcccggtatattgccaacatctcttgaacagccaattacgtacacatatttcgcttcgcccaccaattcggaaacgtaattgaaattgactggtcagcgcaatgtcggttgagatgatctgcagtggacctgaccccactaattagccactagagtcggattgagtttacgtcatcggaattgagctgagaaaaaactgaaaacagcatccctaactggtagtgtagaacagctataagaattcggggaaacctatgttgtagagaaagtacgtaagtatcttgtgtccaatcttttcacctctaccgcccttacatcagccattttgtgtgtctctgatatctgtctgttgttaaagtcccaatttttttttagcttgtctggccccactaatttaccagtgcgctaagatttttggcggggtacaggacctaactgccgcagatatagttgggagcggaaatgtgaataatagtgccataggcaggaaccagttgctagtcgggcactacgagtagtacgtacggctgcgagtggtagtagaggatatgatggcgatagagacactaaggcgatcatgagctacaggtttctgagtacacatcctcgcacaccatgtaactacagcccaattatcaaattgtatccacggacaagcttgttgcatggcccatgcgctaaaaagccaatgtggagggctcacagacaagtatgagacatggtagtagggtcagggggggggggtagatgttcttcagggggggagtggggagagttgtgcaaagctggttcgacaagctgtgattgatagaagagctcgtggttaccgattacccataatatctgcaccagtcgcaaatccataccgtgttttgctgctcatctacaagtgtctttaggttgctgtgacaatgagacttttcgttttcgttttttcgcagttttcgctttggcttttcgcttgttcaacagagttagtgggatttggattgtttgcatcacgtgcagactgtatccccctcatctctctcagtacaaaaaagtccgcggtcccagctgttgctacccatccaacatcaaaccagccatgtccagcgaagtcacagtcgtcgtggccgcctccactccatcaacctcgattgtcgtgccggtcaccaacaccaacccaccggtaacaatcatccagccttccacaccgccttccacagtcttcatcacggctactccggaagctggcactaccgtcaccgtcaaacagacccagctgcccgcagcaaagaccgtcaccaccgtcacaaccacaggatgggcacctccgtcatggtccacaacgtacatgctgcccccgacgccaatcgtgaccctggagcaatctccagcccccaccacagacgtctacctggtctaccccacgccgcaagcatacaatgtgttcccgtgccagtcggaccacacatactacattcccgagtttctcgagggcaatgacaaccactttgccgtgtgctccaagggtcaggtatggacgtcggcagcgctgtgcggccccgataatgccaccatcttgaacggcactaccgccagcatcaccgcaccactccccgactttgagttctacaccaccaagcccgtcttctacctcaacgcgcccccagtgcagtgctaccgaggaggcgcctgggtgcttgcctacgacactgtggtggcctctgctcagacccaagcaacaaaatacgtcgacgctaatgcagcccctggaggcgctgctgctgtccccacggccgtggccggcgcagcgctgctggctctgctgttctagtggcccaaggactcttcatcaaacgttcccttcacctaataatgcatttttctcaccatcacagactattttgatactacggctttcgcttaggcgggtgtgagagcttattcgatactcgatattgatagttgccgtgttacggggaggctaagccgtggaaactacccctggtaccgacaggccgtgtgtgatcaccatacagccaaccccatgtcttccaccttccaccttccaccttccaccactcgtatttcactcatgtctttttccactgacccaccccccaccaacaagtggaagtttattgacccccggtcgaatcttgtcttgcacctgcacatattacagatgcggtcatagctgtacagcatcaatacagtacagcgcctgtatcggccggtgtgcaattacataagcaacgtcgtggacatttcatctttgccggtccactttcactcacgcacaatacacagctgtgcgcggccgatcaactctcttccccacagatccctctcttggttgtctcacgagaataaacacacattccaatttagcttcgaataagtaataataaaaaggccctatccacattgggtaatcgcaacgacataatgggaatgtatgatatagaattagcactctgcacaaggaaaaaagtacatactgtacaagtagaccctgtatgtaaatggccaatatgataaggagaaagtggtacaaacacaaaaactgatcgatgcagtaatcgctaaatactacagtgggttctttacttggtatttcgtgtttctcagtgtatttctgcgtcttgctactcgtatatactatatatagtatgtatgtgtgtgcttgtacttttagtgtatgcaaacatcgttaattaaatactggtgctgagatcaaacacccaagctttcgggaatccacatgcctccgcaccaacagtttcgttggaaagcaaacgtccaatgtgtgccagtgaactgcttgccgtcagatgagtccacaaacactgacgttccagcacatcgctgacacacccgcaagatgcttccctcctgtcgctcgataatgaactttcgcagacagtcaatcttcagacccgtggacgtcacgttcctgtagggagccatggcaggtgttggggccggacggccgtcgtagtgttcgtcaaggccgagccacgacacattgtaaaagtacaacggcgacagatcatttgtctttcggaacttgtcaaactcatcaacacaccgtttggccagcggcaagaactgctgggggatcattccctggaacaggagctgctgctctagccccaaacggtcctccacgttttcggcgacctgcttcgtgtgtgaatcaataacgttgaaaagctgctcaaagaatgtcatggagatgggtgtgaagtgcgatagttcccgttgtcgctgggacgccaggcctgcctcttgcgtctccgttccaggcttttgcatcaggatcgtgtctagcgatcgaatgcctcgccacgagtacatgagcaacattctagaagaacgcgccatgaccatgggtaaagccacatgctgtttctggaagtaactagggccttcgttggaggcagccaacagctcctggcagagataggcagcgaaatcaagacaccatcgcttaagaccagatagagacatgagatagtggattcgcatggcatggttgggggccacgcctggcttctgctgtccaatggctcgtagagtaaatgtcaaagagaaagagacgagacggaggttgaggaaacaccacgaaagacgcgaggtgacatttcgagtccatccgtgctgtgttccaataaccgtctgcatggtcaggagtctttggagagatgggttgatcataattttgtccatctggtggtcctttttgagatccagcgagaagttgatagccttgtgtgactcagctagaagtagcaacgggaactgtgtctcaagagcaggagccaatttggaaacccgctgaatctctcgtcgcattaccatcatgacatcatcgttacagacagcagaaatgcacgaaaccgagtgtcgaagagaaaggacaaaagcggagtcaaccatctgggcaactgtgagatcggcatcggggattttgttgtcaatgattcgtagcttcagtccatctttcgtcttatacacgtaggaggcacacgtgggcgatacacaaatgtaatcaggacgatctgagcccttggggagaggagtaaaagcatagccagcatcactgaacatgttgaaaggcgttccctttgtcgaagaagacacattgcctctgtatctaaagttgagaatgccgtcttcgtgtgcagcgaagaagatggagtcatacacttgcgagccaatgttgacaatcttgttggaggtggtggtctccaccagcgagataatgtgtgtcttgtgcgttgtagttgagctggcggatgagtcgttagtgccgagtgaataaaaggtcgagttaagatccggtgtatgtgattgcagttcatatctgtttgtagtggctccctttgtatccgtgaaaacgcacaccatttcagcctctgtttctgacgacacttggttcgaccggatgctgaacagtttgaggtcagtgagtcgcgccggggcacctgattgcggcataagtgtctccttgagcagtcgagttgctctcagtttaggttcctcctccttggaccactccacctcgattctgtagaggtagatggctcctgctggcgagtagcatgccaacagcatcttgtggtctttggtgcctgcaaaactggcatgtgaaatgatgtcgtcggaatgcagctggttgagtgatagcttaacgaggttatatggctgcgaggggccgttttgggtccacagcttgagcacctgcgatctggtcactcctatgcatgctccaaagccctgagggattcggggtcccaaatgcagtccctgactcactccgtaagtgacgctgatgccggagtagcccagcagctgcgaagtttggccggtagggaaatccttcacgtccgacagcttttgtttcgatttttcattgcctcctgctttgagtcccgggttggtcaagatgacgggcttttcaggagccacccaggtgaatcctacaatggcgttgagatcgatgggagtcgtcagttcctcggatggcggctttctgaggcatgtgatgggcgatagtgtggtgtactgactgtagatgtatagagagcccagagtgtcaatgatggcgagatccgatcccgaaggagaccactccacatggcagaaagcgcgatgcggagtcacaaacgaggtcgtcgggggttgcaggatgcttttgggagcgtacaacgtcggcttggtcagcacccagtcctggccatcggtgcacaccaacaaattggtttccacgccctcgtcgcctatgctggcaatgatgccgtttctgttccacgaaatcgactcgcgtgcgcccagcttgggctcaatgatgctgtcaaagtcgattgtcatctgcacaggttgatttagttgcgtagctggggggttgactggtgatgtaggtattgcaaggttgggagggtaaatcagatgtgcatgattccactctatgtggtcgaggttgtgggagggtgcatattggtacatgctgtggtatcgtacataaaccaactgatgggctgtatggcgttgtgagatggggtgcgtggtttatataataaaaatattattctgactggtacgatagagtatgcaatatcaaagttgtctacaatgcaattcacatgaaaagcacagcagtctacaaggtagaagggtgtcaatggtataggccaacacgacccctgcttagtaatacaatacacctgggtaacttttggcacatactgtacaggccgtttaatataatgccctcttcaagtttggtctcttttcagacaatctttgtcacactgttcaagtccgaagacgaggttcgacaagaagcttaggggaatgtcttccagtaatccacaacaaagcttggtgtgagagtagaggcagtgtttttggtatcgttttgaggctcttgttggactggttacgttggtgttgtttggtactttgtgtctagtccgcctatcttgctataccataagccgtcagcattatttcactaggatcatcgaagcatgtacacacttgtacctgtacttgaaatgcgactcagaacacaaccacaactgaatgaataagtggatagtatttatgatcacaatgatggtgcctcattgcaacctcttcagttatagctctcttttaatatattcaatatgggatttatatcacatgtatccccggaactctgcagtgagaatcgatactgggataccagtacatactacagtatctatctgtatatttgtaactcagagccgctagtctgtattatttgatatattcaatcaataaaatcacgagaattccatcagttccctgtacttctctcacccagttggcttcataaagtctcagaagttctacattcagtgagagctatgatactgtatggctcgggatagaagcagtatatgagcatggtcgagagcttccaacgtacttttggttaaaaagactcacttgttgacaatataatcatgctatccccaaacctccaaacctccatcgcatcgaacatggcactacctgtatgtacgcatcagatacacacagtagttagctttagttgggaaacaattgaaaagccatctctactggcacttgattcagtgttcaagaactctctcaagaaagaaaaatcgacgcggttacatataatcgatttggaggcgtccctgggaatagaaacattacacctcatagctctctaaactccaatatatccgttaccgtggttttggcccgagtatattttgttaaggtatgcttgaagacggagtcttgaacagtacgagtgcagtgtactgcagctacagtacctccagacagtccactcaagtgaccccatacattgtcattctgttgaatgaaaagatatggctattacaagctgctacttttgcttattgcgtgcgtttcagaagatacaagattggtactacttcccctctggtatctcttgcttgtctaacagagctcttgaccctcggacaatgtcgatactgcgtcctcggttccacgtcctcggctccgcgttataatcgctcacgcgtcacaatgcatacatacatataacccgacatgcgattgaaaattcttcgacaagacgagcatctattccgagttgccacgagcagtagatgaaggttcagctgctactgtaaccacgtctcattgctcggatacactgaagatggctccaccccgtgttaagtttaatggggtgatgagtgacgtgacgtgtagctcgacttgtgctgtaggtagacgtacagtagcgagatgagatgggatgagatgacttggcgatgagcaaattatatagtctgtcgaggtccaccttcaacctgcgacgccaaacacagcgcccatcttgtcacatacttgcaccctatacaaattggtctatctaaacgcccccacacccctttcacagcaaaccgctcccaaagtcaaagtttaggcacgagtggtaggtagagtggaatatagagcgtgcgaaacgcgactctccgaacaccacctcacacaatgcaccactttgtacgagacgaaggtcaccaccaccatggaaatactctgccggagtacgaggagggcaaccacgacattcctgagggccagtacacctccaacgagagcgtgggcgcggccatgtggacctacgtgctggtcaccatgctggcgtttggaatcatgttccccattggcctgataatgggcctggctagacacagatacttcattcccatgcagattgtggctgcggcaacggcggtcgtgggaatggtgtttggactcacccatggcggccgacgatactcgcccaacaatatcgcgctcatctggggatggtgcttgatggtgcttgctggcatccaggttttcttcgcagtgttcctgcagatcccgctgcgaacccgagagggagagctcgaggaaaacagcgtgctcagacgataccccttcttctaccgggtgcgaaacgtgctctccaagtgcctgctggtgctggcctgcttccttccaattgcctcgtgggtccagtttggcttcatcttcatcaccatgttcggctggtgccacgaggaccatctcggccagtgtctggcccacggaatcatgggctcttctttcatcgcctacggatgcattctcaccatcatgctgctgttgggagaggcctggctgcagcgacgaaacgtgtcccaagagttctacgactccacgatcatcatgctgtggggaatcgtcaacacctttaccgagcacagatggggccagccttggtctcatggagactaccagcacacctccatgggcatcatttggtggtgcgctggtctggtcggtattctgctgtctcgaaagcgatgggttgctggctctccccccatgcgaaaccacatcccctccatcgttctcatgttcactggttatgccatgagtgagcacgctcagcatctggaggtgtccaccaaggtccatgctttctttgggtgggctctgattctcgctggtctcacccgaatcatcgaaatctcctttgtgctcaaggacggcccctcaaagctcgccgtggccaaggcttggcagtttctgcctcccttcctgctcgttgagtctggaatttgtttcatgggagccaccgaggagcagatggcttacctcaatgacgctggaatcgaccattcgtcgtacctgctgaccctgtcgtcggcagccttcctcgtctacttcctcttcctgtcgctcatcatgctctacaagtacctgtcgggcacccagttgacgagccgggattcccaccggggtcagcatgttcccctcgccaccgaggaggaggagcttggcctgaacgacgaggaggccgacaagtttgagattgacgacgaggaggatccctctgagggctcgtcgtcaggacgaagggatgatggctttgagctgtcgcttctgcgaggtaaataatcaaataaatatatagattttggacttgttgggggaaggcgcgttgctacaagacatggggtacttgtgatgctgggctaccttcataattggcgctgccagggtcgcactgggtgtaggcctttgacatatgatacaccccaccctgtgctcttcctgcttatgccctaaatgatgtcttgaggacggtatgccttttacttggtaatggagttatagtgagatcctgatacatattgtatctacgaggtgtctactactgtagtaggtactagtatctcttaaccccatgcatgttcttgtgcattgatgtaagacactggtgaacatgggaagcatggtggggtgtcttacttgtgattggcacgcgcgattgagaagatgcttgtgaagatgttggagagctgtgtacaagtagtataggtacggtgcttttagtaccagtacacgtattttttgtactgtacttgtacttgtactggtatatgtatgtccctcggtggagatcccagatacgcgacatctaggaatttgttatgacccttgatttgatggagtataccgcttgtgcaagtgcaccagacttgtttcacaaggatgacatcaccaaattctctccggcttgtattctcgtacaaggtactaggaatcaactaccggtacttccgctgtcgtttcctcgacattgataaaactattgccggctaataatgtcctccctttgaagcgccctctcgaaactctcaaatgccaccctggctatcgacggaacatcattcttctagcagatcacgtgacgggtgggtcccgctgctggccgggattcctctcaccggatacatgccttctaatacgcaagacggatgtatacgtggtgattttatcttctcctgtgccgggcagatgtacgccttgtgagactatttagagtggtagtgtaaatgggttgatacggtagacagtggagagataccggcgcgtacagggtcgcaaagagtgtatttgtatagcccccatacatacggctatagattcagccctgcgcaaccttctatagccgacgtattaccgtcaaatccgccgatccaccgtttttttccgtgcagcaggtttttagcagtagcgaaacgttcatgcttttctgcaaaactttgtgggctcttcctaaaaattccgagagtttaactggcacagacacgacgattggcagcgtttaggaaaaaaaaaatagaagccattcaggggaggcggtttgactctgtttgctacagtggcccgtctgtggcgccgggcgggccgatattgtggccctagagtcccactgccccacattagcgagagtttgacaggttctttgtgtgttgatttagcctggatttttagaccgatgtatattggatggtgtccaaatgttacgctacgttgaaatttcaaaagtttagttttttcttttgatttttttttttttttttgatgcgggtcgttccgaaatcagtttggtggtctctctctctttttttgtatgtcgccagtatattacaatttaattgtgaagattttttcacagcgacgatcccgtggctggtgagtggcgtagtcttaaccccgaagtggggggtcgtctaactccggctttcgctctctcacagggccacacgagctgtcactacgagtacatactgtaggccaccgcagagacagtatgacacaccaccaagaagagccatgccagccggaataagtaaggagcgtctctgggcaactacgtcatcgctcacagccgacggaggtccgatggacgcacgcgcacaagtgactttcttggccttgcacacactccactgagccgaaactctgccgtggaaaaatccgtccggacatgcacaatgcggagggagtaaacggagtgagcggagtaaataagtgtagttacgcgtagctatcagaatacgttctctcctgatcttggataaactcaccggggcaagtacagttacgacagacgagcctaccaatgtcagagccaaataatctcggtataccccgcttgttccaagagcagggggcttgtacgtgacgtagtgtctcttgggctgacgttgggcgcctgcctcatcctactctcctccgggtcgtctttgttcatgcgggcggatctcattgggtgtcgaatgtgttgattatgcactggcgaaacactggatcttttcgctcttgtgccttttttcccttgattggcctccctgcggcgcggtgtgcggtgtttactgagccaaagtctgcccggtgcataacggccgactcggccgagtagaaatgaaatcacaaaaaaagggacaagatcggaacagacacacactctgagattggccaggccaattgcacggctttctagtggctaattacggagcatcaatgctggcaaacgccccagcaccacccaaggtatacagccatgatcagataaacgtaaagccagccaaggggctaatcccgtagagttggactaagtagcgggtgtcagcgacgtcagagggttccaggcaacattcttccgcctagaccgcgagctaggagacactaccggtaccggccgctatggcctctaatactgcagttcgagtacaactgctgtacccatacaatacgcacgcaaattggactcgcctaagacaccactttagggacgagcaggccccgtgaccagccctcgtgagagagagagagagagagccagagagaaaaagagaaaagagaaaagagaaaagagatggagctcatacgactgaaatgccgataccgcacacgttccggagtattaatccgccgattgcggggtgccaaacccaagaggtggtctccacactcgcccaaacaagctcacaggggcgactacctctaaccgccagccactagtgactggggaccggtcgctatcggagcttgaatgtggcgaacaccaataatctgcgttggacggaacctccatataccaaataaggttcacaaaaccaaaatctaggttcaactctagagcgttgtgagctcccattggctgcaacggccctgataagcatgcaccggaggcgtgagcgcacaaaggcgcattgagtctatgcattttagtgtttcgttatctcagccaatgagaggttcagaacggggaatttttgggtgttttgggccgaaaaactgcccttgggccctgcgaggagatacagatggattatagctctctgtagagtctctttccgtctcaatacgaccccaatagctcatgtcaccctccatagtttggccagctcggcgttagggttttctaggcctgcatgaaaaattcatcttcatgtgagcacactacaacctccgagaaggtatatatagaggagacaagtctgtagctttgaatctttctcttcagtaacaccgacaatcacaatgaactaccccgctgaacccgaattccaacaggcttacgacgagctctacaactccatccacgactcgactctgttcgacaagcaccccgagttcgagaaggtcatccctgtggtgtctgttcctgagcgaatcatccagttccgagttgtgtgggaggacgaccagggcaagctgcaggtcaaccgtggctaccgagtccagttcaactccgctctgggcccttacaagggaggtctccgattccacccttccgtcaacctgtccattctcaagttcctcggatacgagcagatcttcaagaacgccctgaccggcctcaacattggaggtggtaagggaggtgctgactttgaccccaagggcaagtccgacgccgagattcgacgattctgctacgccttcatgggcgagctccacagacacattggtgctgacactgatgtccctgccggtgatatcggtgttggtggtcgagaggtcggtttcctcttcggcgcctacaagaagtacaagaacacctgggagggtgttctgaccggtaagggtctaacctggggtggatctctgatccgacctgaggctaccggtttcggtctcgtctactacgttgagaagatgattgagtacgccacctccggcaaggagtccttcaagggcaagcgagtcgccatctctggttccggtaacgttgcccagtacgccgctctcaaggtcattgagctcggcggaaacgttgtctccatgtccgactctaagggcgctctggtgctggtctccgacttcaccgagggcttcacccccgccgagattgagcagattgccgacatcaagctccagcacaaggagctggcctctctctacccctccgccactcttcccgagaccaagttcaagtacattgaggacgctcgaccctggtgccacgttggcaaggtcgacgttgctcttccttgtgccacccagaacgaggtttccggtgaggaggccaagtctctggttgctgctggctgcaagttcatcgccgagggctccaacatgggctgtgagtccgacgccattgaggtcttcgaggccgagcgaatggcccgacctaacggtatctggtacggtcccggtaaggctgccaacgctggtggtgttgccgtttccggtctggagatggcccagaactctcagcgaatctcctggaccaaggaggaggttgaccagaagctcaaggatatcatggtcgactgcttcaacacctgcgttgagactgcttctacttactcctccgagaaggtcgatggcctcccctctctcgtcaagggtgccaacattgctggtttcctcaaggtctctgctgccatgaaggaccacggtgatttctggtaaactaacaattaacgactgtatgatagaataataatatttatatgatgaaacaagacctggtatcgtagtagtagtttccatatttccaacttcgctcgctctaaattcccaaactcggttttctatggcgccactttatcgttccctcttcaatcatgttcgccgcgctcttgtctgtttaccgactaattaccggagtaattaaactcgaatttcactttaggttcaggaaaaactgttgctggcaaacacaaccccctctctgctcttggcacgcatgcctcaggtggagacgcatcatcaaccaaaagtttttccgaacaccaatcaaagggggaagttagcgaggcttacgcggggtctcttccgacgagttccggtggcccgccggtatggagcaagaacacctacttgtagtctacgacggtgtcaagtacggttttgtgaacggccatcatctcccatggctcgtgtaccagagtgggggtaccctcagttctaaagcaaaagcgtgtctcaaggaaggaacgaaacggcggggtttgagagacggcattccagattttcagggatgaaacgcggcctttcaaacaagacggatatcgacacggccctgttattcagaagcaagcattgagtggatctttgcgtagaaggaggcaacacattgagcaaagcacttcacagcaaatacgacaagttctgtagctacccattccgatacacactcttgccgaatacctaatacgggcgccctactagatcttctgtaggttggtatggtatattgcctcagtcgtttcttgtttgacacatgttaccaataatttccaattgccccaaatcctcccatgcccttttgttgcaataatctacgtcccttcctcagccacacccaatgatgtggtccacaataaatccgacgctcaatttttagggtcacatcacacctaaggaaggtaatcgagaatgcacgtctcttcattatacggtctacggcgccggtgggagccatatgcctggctgatatagactcaaaaaaagactgaacgaggcaggggatggtgcttcctatttctcccgagacctgagcggctcaatatgtgggataaaggcattattcaggaacaaccgacagacgaatggttcttaaaagcttaactaaatgacatacatacaaacaagaataatcaaccccgcttcaacaacagttcaactaatatacagaacaattaacaattcatcgtcacaagtaactaaatattgcccattcatcggcaataatcttcaacctatctacagctaccgtagaacacaccgataaagatgctctcacaactctcactgaagatcttcaacctttacttatataaatagcggtatttccaccccgcttactccttcttctcctcagcaatgtagtggaggtaggctccgagagtcttgactcctccaatgtagttggagatgttgagcttctcgttgatggagtgggctccatcgtctcctcggcccatgggcagcagcagaacatcagatttggtggcctgctcgaaaatgagggtgataggaatagatccaccctctcgggtgagatcgggctcgactccccacacggccttggtggccttcttggcggcggtgaagttccagttgttggggtcagacacccagtagtcaccgtcgtggacaagctcgacgttcagcttgcacttagaaccgagcttggcaaactccttctcaacgtgggcaaacacaagctcgtccagcatcttggagttgatgttggggacagttcggatggagaacttaccggagaccttggcaggaataacggtcttggctccagcaccagagaacgcgccctcaataccgtggatagagagggaggggtatcgccatcgagccatgagggtgtcctccttggtagagtgcatgttgatgtcgttaccaccggtagcctcggtgagctccttgatgtcgtagtgaatgtcgtcgtatcgagatcgctcctcctcggttacgggagcaaccatcttgtcgacgccctcgatctggatcttgcccttgccgtcgaccagggtggccagcaccttggagagatcaatcatgggctcgttgacaatacctccaaagacaccggagtgcagatcagcaccggggccggtgatggtgatggaatagtagttgcagcctcgcagaccgtaggtaagaacggggtgggtggttcccagccagtagttgtcggagatgcacacggcgtcaacacccttgaagtacttgtcgccctcggcgaagacgagctgctcaagaccgagagagccagactcctccatgccctcgaaacacatgacaaggttgacggggaagtcgatgccggccttcttgtaggcctcaatggcgttgagccagccaatgacgggacccttatcatcggtggagcctcggccgtacatgacgtccttctcctcgtccacggtcagaacgaaggggtcggtgttccagccgtcctccttgagagcgggctgaacatctagatggccgtagataaggatgttcttcttgttggcatcattgccgtacttggcaagcacaacggggggaagctgcagatcctcggtgccctcctggacacccagctctcggagctcaatgtcgtgagcgcccagagccttgagctggtcaacggtccaatgggccattttgaccacctcaggtcggtgctcggcgtcagcagacacggaggggatagccacggcgtcagagagtcctagtggttagtatggttgattcggttatcggtgtacttgggcggtaactaaaaaacgccactgacacgtcacgagtggagatggagagacacaactactggcacaaacgttgagaccacgacatttccacggccatggcgcgtaatgacacactctctgtgctggtctgtgtcgtgtctttcgccagtgcctgtgtctgtgcaactgtggttagtcccacagacccataaccccactccacacatgagggtgttttagccgccaaatccgcaggcagatactcacgctggatgaattcgggcttgagagagtcgacggtctcgaaaaacttgttgagatcagccattgtgtgtttagatgaggagagagaagaaagaaatttctggtggtgaagagtgggcccgcagagtccatgcaggttgagtgccgtacggttagcgtgccctaaccccagtttggagctgaggccacttcggctagtcggagtccgtcgatccgagcctctgattcctgtgcggcacgctcgcgtcaggccgctgaggtggtgggcgaacgtcgctttgctcatctgtgtcactcctcgacggcttgtcttactgtttcagccgtgcaattcgggctggttttgttcaactggtgcttttggttagacaggaggctaagtgcaaatagcatctgggccattacgcaaccagggttttgatagtgttcagtggaccactgaggtgtctacaaaatctggtggaacagggatatatatgtacacccgaaaacacagcggttacaacaccagtgtgacagcatgatggcataacagacgccatctggtttactcacttttttcactatagatagacacaccatttactcagctatggcgggctaattttttcagcggtcacatgacaatgacgtcagaaaagagagcacgaataatatctgtcttgcagagtagttggagacacaaaaccaaagcgaatcacatataaccgtgtctgcgcgcctaaaaacagtcttcttattgtgccctgcttttgacaccggcctcccagctccttctataatgtgttcctcccccacacatctgattgcgcgttttgagtttgggttgcaaaatctgaagacctcacatcatacaatagaaatcaaatctataccacattccccacaacatagcagcttcttgcgacccgcatttttctttcgacacagaagcaaaccagcgacattctaactcactcgcagcaacacgcaacccaccaacttttagcaataccaaccaccccagaaaacaagaacacagttgaacagcagaactcatgtcagacgtctcttcgatttggaacaagaaacacagcgactttagtttcggcacgggattcaaggacttcaaggaaaacggcgctctcagccctgcatcgccaattggatcgtccatcggaggaccatggcgacctcgagcaggcaaggactcttcggcagtaggagctatcggagggtccaaacggtttgaacggaaacacaacggctctcaccatcaccacggaggaaaccaaggtggcggaagcgctcccagagtgccgtatgatgacccaagcacgcctctgatggaccccaacacggtggtcaacgaaaacaacgaggtggtggtgaccccacggctgggccaacggatcctggagtcccagtggaccatctggtttttctatcgggctcagggcgtgcgaatctccaactacgaggcggccaccaagcgagtatgcacttttgccaccgtggaggagttttggtcgttctacggacatctgaaacatgtcgacaagctgccatacacctccgagttccaggtctttcgacggggaatcaagcccatgtgggaagacagccacaacgtgtgcggaggcaaatgggtgtgcagattgagacgaccttcgaagcagtttgccaaactggacaacgatgacgatattgttgtgcccactagagcccctcccatgcagattgcctctctcaggcaccaggcagcagtatactgggaaaagctattgttggccctggttggcggtactctgttgcccgagggccagtaccaggacgagattgtaggagctgtcatctcggtacgaaaggaggaggatatcatttccgtgtggaaccggactagcaacgatccccaggtgactgaggctattcgagcaggaatgcaggcggttctgggagttcctgaaagtgtgacctttgagtacaaggtgcactcggacagtctcaaggagggagtggagaaacaggctctgtacgagaccgaggagaagtagcgtgtttgtcagtatcgtacatggccacagcatcatcacggatgttaccagacggagagtgttcgattctcgtctatatatagcataaactggataatgtgattcaagaaaaagatgttggaaaagatgttggtagggcagaagtgttgcttacaaatcgtgaatgcctaagaatcatggatgggaagagatttagtgaaaccatgaaagatggaggtgcggctgttgaggtatagctatagcacatgcccatctgtttcctactgtctggcattgtttacatccacattcacggcaactcctttgatgtgcttgttcatgggggcacacacagcaaatcattagcaatgtaataatcgccctacttgagagctgtcagaggtcttcttcaaccgttattttactctgtgaatacacatgcgacagtattgtaaggatccttgcgagttgtgtgaaggtacattgatcgactgtcttctcctggtaggtacttttgtatctgatgctcaacgaagcttgagctacaagtaccaatacctgtaaaacactggagatctttattaaagctcgtcaagatcgagactggaccctggtttgtctcatgtgtctcattatacaccattcttgaacaggaatgttcgagacgcgcgactcagatacatggccagttgtggcttttctgatttccatgtcctattctgggcagagtcaacaaactgtcttgagtgacagaatatcctgaatgtcagaaacggcaaaggatcattgcaactctttagttctttttacactgttcaatctttggccttacttgtactattcacacagcataacactatgtactaccatagtagatggccatcctgtggtctctggtaaactgcccgtctggggaatatgaacaattgaagggagtgcgtggacgacataggccatcttcaagccattgtcagcctgacattccaatctttaatatgttcagtccaacttcacgtcatgttctatgttcatgtctgtcaacgttgataattgccatgtaccaagctgtcaaaggtagatatgcataattctgtcaaccgtggatggaaacggacgttgatatttgaccattgtaggagacagttcaccccgccactcttcgggctcgggtttctatcgctttctacttagcaatgcagggtacctctgacctgcacggaatcgagcagcgtataacgtacgatcgtattcgctagtttgtattctccatacatttcgtacttgtactcgcacttgacgtcaattgcttccaaatatcgtatcaaaccaaaccatggctccgagagctgtctcagagctttgacagtctgggtcaagaccttgtgcacttagacacgtctcaggcaccacaaatctaaccaagccgtaccatggttacgaagaaggtcagagaggagagtttcgtcttcacccgagtagatttgtacgcatttgtaattccgtagttccaaaaaaagcgtgtttacgaccctatgagggtgtttacgacgaccctatccactcctctctcatgaagttgatgattgctcttgctcttggcagttgcttggcaacaatgtgggatttgcaataccatacgctaagtcaataagacaagtgttgccagaccatagctgtggttattgaacaatgtagtccgcacccataactcccgcaggctatacgtggacatgggatgggggtttctatccataaatggcagttatgctcgccatcgaacattgtctaatggaatcggttagccggaacattaaacccggcagtttgcacctgtgcagacgagttctgtgcgacattaacagcggcttctttgtctagggaatttgagacaaccaggctttgtagtcacgtctaggactctgcgctgtccatcgacagccgccaggtgtatcttagtttagctccaattacgactttgatctgcaaccaaccgtgaaggagagcgggaatgcccagaggtcggtccgaagccgtttttggggactcaaccaggtctgtgcttgcgatatgaaccgagggccaagaggtcgcatggcccgacaaccaacagccgtcagtgcataccccgtacaacaagtgtctgaacatgcaacaagaatggctttaaccgcccgcaaagttgctcctcagaggttctttgggaaccgctacttgtagcactcatgtctctcttattatggcacgggaccaagtttctcaactctacccgggtcggggacagctgagtttgggccagggaaagagctgtaaggaaggagacaactgagacggccccgcaagcaatcaatagagcggcagggagaggttggttgcgaagcatcctccgtatgcgggcctgaacaataactgctgaagtgcgcttgcgcttgtcaccctactgtagtgtatgtactttgatgagggtaaactcgaggtactacatgagcacagccttcatttaccgaccgtctgcaagttggtgcaagatgagatggggtttcacatttcgcagcggctcgaacggaagtgaggaggtcttcatttcgagggtggagagagcacaaagcgcagctgttcgccaatgcgggctttagcactctttggcctgccaagttgtgtttatgggaggagaagcgagagtggatcgagctttcaagatagcctctcttgttgcactttcccgttttccggaaaaggccgttgtcaaattctctttctcgatggtcctctcttaaactcggtcaagagagtgaaacagaggagtccgtcccagcagaggtacagcaataatggccaacctaaggctagccgagtgactgagtttggactttcagtttgtcgatacactctatttatatggttggtgcattgtttgaggggggggcacgtgatgctgaggggctgtcaaatggttgatcttaatggcctaggcctggaaaaaagacactagctgtaaatagaccggaattgcgtctgtttcaaggccggtttccaggttccatcctgcttcccaccgaaaaccagaccctatgattgccagtgtggcccaaagtctgaagttattgatgtttgcgcttccagcggttcgatgtctcactttgccactgtctcagagccagtctctcagaccatttcttgttgcatttgagttgagtttcggtggatcgttgttaccatgagaaaaaactgggaaaaaataaaatccttggagccaacgtatggtcagagaccgagaagcacaagtgagactcaagtgcaattgcaagtgcaagtgagaccgtcagtttggaagcgaagttgcaaacttcccgctggccgctctcgtattcgcttggatggtgtgtctggtattggcctcccttcactcttacacagctcgccgtgcagccctcaagtatcatggagcctactacagatgaacatgaaccatgttacacggcacggctagaagggggagatgcaccgcctgagacttggcgttttaccagctgccggctcgttacgacttctcttaaacccagtcagaccccatcagttgccggacatgatggaggctcctccatcggttgctctcatgcacgggtgcaggtccaagaagtactccgaagaaatattcggtgataattatacaagaacaatggatgtgcagcagaagcacgaaaaaaacccggagacaacttaacagcaccggagttaagcactgtgcacctcgcaggcctggacatgtgccagggacactcaagctcaatggttgtggggaagtgggggtcgtagaccagttactacacttgtactctcgtacaagtagtgtgtctgtattcggctgaccagttagctcgtgccaagggtctattgtcaatacttcgactaagcatgactccttggaagacgtaaaacaaatgtcgtgtgtacaagtgtcggtacatcggataaagcaagtatctggacggagctgtgacgacggagaattggatacgtcaccgatgccattggtctacctccgacagatggacggtctaaagtatcgtaacatgaccatgccacttcccaaactcgttagcagctgaaaaaggagtagcaaggctaattacaccgctgatcagccttgcccacactgaccctttttcgcgcacgtacatacatcgttactcgtatatgctcatgctcacgcccgctgtgtgtgtcaatggctgccgacattggattcgcaagtagagagacgctttctagcttttcattttcacgcaaatcttggtttaaaaaccgtttgactttgagcgacaggcggtcaagttcaactctaccccagcgatgtcggacgggttgcaaaattcctccaaaatcctggcttttggattttcccgtcttttcggtctcccgcaaataaaatttgtgaccatcatgtcgaccaccttgtactatcgcacagaaaccacgcacttctcgcagaatattgacgtagtcatctgtaccactcgcatgcaatcacgtcattctcagcactgagtcactgcgaaacgagaccgtgcgctgaacgtgtcaatagccagctatagaggagcagtgctccgtgcaaaggtggctaatagtttggtagtgcacctgcacccggactatcataataatatacgcacagtagaacaaggtgtgttcggtaggtgtgtatcttaaattgccagatccataaacaagcaccatggacaagcactgacaagagctcagtcaccgtgcagcacagacaggacggcgtggtgagacggcaagagtcacggagcaggacggccggtcaactggtcgtccgggtcacgtgctacactcgccccccgcctgccttgtcgtctccatttctcggttgttccgccacgtccacagccactttgaaaatacgtggtttccccgtagtttgtccgactcgggtggctaggggaaccttcatggctctcacaagagctgtcacaagggctgggggcgtacagtgacaaaggtggtgtgtacaaggttcaaaaggtttttgtcaaacgagttttttgtcggtttttgcccttggtaccctctctacaaggttggcgcacaaccttgtccatacagccagaacgtgcagccggacacaaggtgccattttagggcatatttataagggtttcctccgagtctaaaagcttcttttggccacccagggcattttgagctttcctccctacagcacttaatttttggtagtcccacacagcagatcctttttttcgattttttttctcttctcctacacaaccagcttggagactccaccgttcaaaaacacgaccgttcgcgagacaagcaaacgtctctccaccacctactcagcgtgatactcctcaggaaccccgtgggtgcggaataaaagacacaagagccaaaagacaaaagcgcccccacaaaccaaacatctcctctacctcgactcgcactcctgacagccactttccctccatgtttggaatctctggctactccgagtcggatggcttcaacgactttttccccgaggacaacgacatcttcgacaagttcatcgacgtggacggcaacgccaacgactcgcagaaccacgcaatctcccacaacacccatgtcatctccgccaccaacaacagcgcaaacaacaacaccgcggccatcaacgccaacatagccgagtccttccagcagcccgttgacctcatgggcatgctactgtccggccaaaagaatgtcaaccaacagacccgcatggacaactcgcactggcgacggcagaacgtcccccagcagcaacaacagcagcagaagccccccgcccatttcagcccctcggtggcacctaccgtggccacctccagtgtgaatgtggagtttgggctgctcagccccgatgatggactggattcgcagtttggctcggtcaacaccaacagctcgtccttccagccagtcttctcgaagtccaactccttctccaacgaggccacaccgtcgggactggatatgaccccccagtccatcgttgactcgcccgaggagcccagcaataacaccggcaagggaggcatgttccagattggttcgtatgacacccccagcggcatggcccagagctttggagcctacaacaacgccagcggcatgatgggcggagctaacaataacggaaatgccaacaactcgacgacaaacctggccgacaacctattcaccaacaacctgcacaactcacaaccgttcggctcgtacaaccccagcgcatcgtcgtcctcgcacctacatagccagctcagcagtataccccagggacagcagcacaacagcaccggtggaggaactggaggaggaatgggaggaggaatgggaggtatggcagcgtctgcccccgcagacaactcgttccatttcgctctggacccattggctgtcgagggtatcgacttctaccaggaaaactctatgccttctcaccagagccaaacgcatctatctgcacagcagagatctcgctccaactccattcgaggcggtcctatccgacgaaaccggtcgtcacacttttcctctccctactctgcatctcccaacgtccagttccagacttttgcgtcctctggccaccacactccaaatgccagtgtgccatcatcgggagcttccacccccgtggaagagcctctgttcttcgaccccttccgaagcaacaacaacaacgctctgaccaaccctcactcgctggctaactcgctcagcagcacagccattgcccctcctcgagaagcgcggttttcggtttcttccgcctcggcgatggcctcggagtcgccctctcccgagcagagcacagctgccacttcataccattcgggcgtaaatctctcgtcgccacacaagcagctgctgcctaaggtggcatcctgccggtcaatgaccacctccatgggctccaacctgcgaccaatcaagcggcaaaactcgtcgtctactaacctccgaaaggtttccacctcggcctcctcccagacgctgtctgccatgtctacatcgtgtccctccaacaaggaagcgctgcagtgctccaactgcaacacaaccaccactcctttatggcgacggtctcctgagggagagtcgctttgcaacgcttgtggtctgttcctcaagctgcacggtgttgtccggcctctttctctcaagacagacgtgatcaagaagcgaaaccgagcctctggaaccggcaccacctcgggcaactcgtcgttatcttcttcgctgaccaacgacaagtctaaccccattgctgtgcctcgaatgactcccattgcgtcttctgcgtcctacggcaagaagattctgcctgctgtggctcccatgtcggccaccaagtccgttcctctggtgcctattgcgcctcgaccaaagccctcgcagtcgcaggcccctgttcccattgcgcctctctctaaggaggcctacattcgcaccaagaagtccaatctgacgcggttggtcaagcaggagaaagatgaatatgactggttgaagttgaacccctctacttaggcgcactacaaaacgacacacagcacacaactaaaagaacaaaaaaacaaacacacgggaaggggaaggttgcatggtgaaaacagctttatagcgatcataacttaatttattgtatattaatggaatactagtggatagaacaagtatttttccgagtgagagtatgtacagtacaagcacagatgtagtttcagttagctggtctttctctccgcagatgcaatatactgaatgagtgaatgagtgcaacgcaataatcgaaagtaaaattgaactccttttggggtgtggagatcatagacgctatttcaagtgtaaaaacttgctattttgatacgagcgataatacaggtttggtacgggtgcacagggcgtattctgtggttgtttttttagcacattcgggtacgtaattatgcgggcttgtctcacaatagcagcagtcttacggtaatgtgatgtgattccccagcccttctcttctgctttcactctcctctctttctcagttggttgcaacgtttccacggatcccgatctgtacgttaactcagactctgtcctgcggtatgtagggttgataaatggtcaggtttataggtttggtttgattggtttgagggactatactggcgattggggctgccttggattttactactagtaccactacaagtagggaccgcctcacttgtgctggtaatatgggctcagctacacggttgaatgagaacaaggttggcccatagtctacgagtagtctagcccaataaaatatggaagaaaaaaaacagttcgagccagagtatgacgaaggtgagcttccgaagcgatatcggcgtacgagaatgatactctatggcaatttagctgaggagaaacacaattgaagagtagattgagtgtgaagctaagggcgcggttaccccatgaaaaccatgggcactactgcacgagtacatacatagtcatagtggcacttgtccttgttataatacatgataataagtgtatttcacggaacgtgatgacaggtgagggcgttgtgacaatgacagctgaagaacataccaagagcccaaaaacggaccattgctactgtcaacttatacagtagctgccgccaaggcttctttgtgtccgtcgcaggttccgtagtctcgtctgatcagcccagatccatcagcattactctgcattaccacatcgcaaagtgattgggctagggacaggttagaacattccacggcagggtatgaaggtgtagccttgaacttgacactttccacggatgaagacaatgtgtatgtacgagtacaataccagtgtgtgacccagagtgtacccgcgtacagtagccagatcataacggccgtgacatctgaagcggctgtagacagttgtaccggcacaattatctgtgagacagaatgtgtttcaagagaccccatgtttcaaatgggaatgactgtcactcctgctctcactttcaaccggcaactattgtacgagtagtgtcactttgtccattcaagcatcagcatatcgatagcccgaatgccgttttcgaaaatgggctcggggtactttagaaaaaagtctcgtcgaatgtcgctgaaccgaaaaccgcacttttggtaaaaggccaggttgtcgatagacgagtttgcggtgcccacgacgagcttggacacatgaggttgctcctgaagcagctttatggccttctttcccagcccctgaccctgattgcccggagctatagccaggtttttgatttcgtctccaatcacttgcaccacccccaccacctctccatcgtccatagcaatcttgtacatagttccctcgtcaatatacgtctggacgatttcctcgctttcgtcagctatgagaagcagcggcagcagcggcagtcggaggcctggagcgacggcctggaggttcatgcttgcaaagtctcgatcccaatcagattaagtgtgcggtgtaggctcgcttaactaaaggcgataattaaggggcaccggtagagttacatcgaaagccaaaagacaaaaaatgggcttttttttgcggggcatgggtgactgtaccagaacgcagtgtgccggaacgtacagtacatgccggtatgtacatccagcatagccacgtaaacacagctataggtgttgttgagcaaaggccaagtgggggcactacagacctcctccgcccgccctctgatccacccccacccatgtaacgcacgtgcatatggaccctaaatgagctgtttcagccaaacgaggctcggcgtagactaaagtagcctgattatgagcactcttgaggggccaaggagaggtggtgggggggttaaatagcgacagagattgtttgtattgattgatctattctcattacattgtctctggcacttttaccacccaaaccccctcccgagatgtctccatctcaccctgcatcagcttccgatctactggtagggatcgtggtaatacgtaatacccagccaaacgagccgtcctcccaacccatgcataaagctggacaagtggaccaagtggtcccaacatgaaaagtgtgctgttattacgacagcaaaaaagacaacttgcacactcgccgatatattcgcacccccatacaacctaagccccgacacgacaagaggactggacactggactctggaggcataacgacatccaggagatagccaaagcgacccacagaaagaatcacatccgacaagaaccatgtcggcccctccctcaggccatgcccgctctccaggcatgtccatcatgtcgctgctgtcagatgataacaactccaccaaccagacaccaggaagcccattagcataccagcaatcgcctccccaacatccacatccgcatcagcagccgggccctccgccccagtatgccaccacctttagctactcgcagattcagcccagacagggcgactacccacttcagcagcagcagcagcaacagcagcagcactatccgcctccacaacagcagcagcaaacatatcagacccaataccaacaaccgccatcgcaagtgtctcctcccgtccgggcgcagcaaccacctcagcctgcggctcctgcccctccgtccaaaacagcttctagtccggctacccctgctacacctgccacgccggcagcggcaccaactacggcggtgggaaagaaggcgggcaaggcggcatccacagcagcgacagcagcggcaaaaccgacagctaccacggcagcagggaaacggaagaaggctgacgacccagcagcgccaaagaagggaaagaagaagcaaaagaaggatgatcagacacagcagtcggtgggatccattcctattgtcactggctccgacgacaaggtgacggcaaggcccaaggaaaatattcctcctcctccttcagtgcccatgtcgccaggcaagaaacaggcccagggactggatgccattgggcagaacaaggacgccggtcgaggctccaagccggaggtgactctgcgactccgaatccgtctggctggaggaaacgtcaaggtcaaaccctcacagtctgttctcaagaaggccgacaagtctgctgcgttgcctgaacccaaacagtacgtgattgataacgaggagtacgacttttactccactccagacaaggccaatgactggaccgcatcagctgatgataccactgtgctcaacttcacccgattggctgaggacaagtacggatacgatcatgtgcaccccaaccaggctcttgatctcgtggacgacgatggagaggtggaggacgacgacgaagaggaagaggacaaggacaaggaaaaggaagagaaggaaatgaaacggcgacagcgagtggagggtaaatacgatcttaacgatcccttcattgacgacacagagactgcatgggaagaacaacaagcatcaactcaagacggcttcttcgtgtactccgggccactaattgaagaagctcccaagccggtggagaccaagaagcctgccaagaagcctggtcccaaaaagaagactctggcggcaaaggaaactgaatccaagaagaaaaccacccctctcgcctcagctactacatcatccacaacctcaacaacagctagcgctacaaccactaccaccccagcaacagttgagaagaaagcataaccaagtattatatctttaatatataaagaaatttttattctcaagaaacatttgtaaaaacacccgatcataacccattgcccagttttaacggctttttgcggcagaattaagcttttttctctgggtcacgtgagtttaatggcccaagaaaacggaacacgttccaaaaacgtcactatcggaggcccgatggtttagtggtataattctcgcttagggtgtcctaggcaatttgcgagaggtcccgggttcaattcccggttgggccccttctttttgcttgctttacatgtctatccttttctttttcatctcatagagctttgcaccgcatggcgtgtcgctccaatcaagggatatgttcgcgtccaggttgattaggttaagcttcttatacgaactttatttggcacagatgattattttgatcgatctttcgtatctgatgactgtatcgaaaatgtaattatctccatctttatatattaactacaattgtattgggtacgccgaattacgtccttgtttgatatcatatcatcattattcgtgcataaatactagacttagagtcgggcgagagctcccatgggatcccacagaggcagaaccttgggctcctgcttgagaatctcaagaacctcaggctcaacgtacttgtcggtggtgaccacctggaagacatactcatcgaaccaagcatcggacatctggtaatagccgtccttaccgttgtccttaccccaagagttttcaattcgccatcgaactggctttccgctctcatcaagatgaacggcagtgatggccattgcgtgggtcatcatggaagaacctgtctggaggcgctgcttcttgttcagtttcatgctggtgttgaaacccaggttgtagtcccaggcctgagtgtcgagcacaccggactttcggtctccaaacttgccaacgtcagaaccgaagaaaacagcctcgttgttctggatggccttgatggcggccttcttgagctcggaaatatccgtgttgacgtagtcaacgtgggccttcgctccaccagcaacattgttgagtcggtcaacggtgtatcgcttgttgtactcgtttcgggggtcgttgatgagagaaaagtacttcttgaagtcgattccaatgagctcgtaaagctccttgggggtcagctgcagagtctccaccttcttggcggagatctcgagctccttgtcatcagacaccttgtctcgggtctggaagtcccaggtgaacttctcgtccacggcaggaggagtgcccagagtgatgcacagaatggtgtggatctcctggaggaagtcggccttcattgcaagagcctcgtccttcttgccagccttgaccagctcacgcagggtcagagcgtactctcgcagcttctcggtgatgaggtagcacatgtttcgggagttctccgagttccacgagtcggggaacacgtcgagaggcacgaggccgtacttctccactaggttgatgatcatatcaaactggcctccgtcgttgacgggctccttgagcagctcctgcacgagccgcgagtcgagctcctcgtcggcggtgtcaatgacattatccaggaaccagttggacttctccagcttgtcgtagaagaagagataggtctgggagaactggaacgaggggatcttgagcttttgctgcagggcgatccgcagcacattgagcgaggcgaagatccagcatcggcccgaggaccgctggtacgtgatgggggtgccctcgagctggatctgggtgttgaagacgccaatgttcttgttgagggcggaccggtcaatgatcatgtcctggaagttacctcgcgagatggcggcctgcgcgagtctgttcttgtccgacttgaaggcctgggtcttccaggcatcgagagaggcggtgttgacggggttgggcgacattgtggagtaccggcgggaggaggtaaggtgttgggctagaagtggggttgtcttggacggggctctggctctatatatacttctcattgtggtgtggtgggataactaacaaggttgggacaagtggatatggcacggaagccgttcatctcaaaagaactccaagttaagtttgtgtggagagagctcatgagaggtgcggttccttcaatgtggtcatgtgaccagataatttgccacggtgtcctccaaggtctgcaagaacccccgtcaatctcaatccactacaattacgatacttgtagtgctgtctccatcgcaattgaacgccaccggccctcaacagttcctctgagtcgtgccttgtatacgaaggttatgcggctcaagtgacagtgtcagatcttatcaagaatcactctagataccctacggagcgacagggagtgataaggtgctttatgagggagtttgatcgtatacacaagtccaatgtatccgaaaaaatctccaatatgaccttttcacggctcaatctccctagtgtcgtcttctatactgcatttccgtgtgccgtttcttcggactccgtagtgccgtccactactcatattacatgccacctgcaggcggagtaacaacagaacatcagaagcaagccaattggggcataggggtggtgaaatgagtaatatattgagtcagagaaacaggttgagatgtgccgtgtgtttttttttggtgcacatctagcgacaacatccggacacttccagtagatatcctacttctgtacgaataaagtagaagtactgttccaactttttgcactgtcctcatgaccacttagtacaagtacataactttctagatcactttactaaaaccaactacaagtatttttttaataaatcaatctcaatgtatcattctatagtgtcaataaacagttttgtgtgtgaatcctccgcaaatcctccatctaggccttctcgctggaagcagccttcttcttgttggctcgcttagccttccagtcagcaatggcagcaccagttcgccacactcgaacacgggccaggtagtagcaaagaaccatggcacagatgttgaagatgatgtaggcgcagatgaaaccaacgtttcgccatcggtagtggtacttgatgcccacagtggcaatgaactcgtcagccacagagtaagggcagtaaccacactgggtagtggcgttggggtcctcaaggtagccggtggcctggctcaggaacttaccagcatactcctgacaagtctgcccactgggagggttgaatcgagagaactctcggggcagacaggtaatctttcggtcatgcataacatctccaacataggcctgaataatgtaggtgaagggagacagcttgtacatgaaggtccagaaaccaggcatgagagaagcgggttgcataacaccacagaaggcaatgacgaaggagaacatgagcgaggtaatgatggaagccgagggcacatcaggcgaaaagtagagaatccacagaccgaaggacaggtagtacaggttgaacagaatggcgtagatgaagtagaagtatccggccactcgagcagaagtacctagcttggtggggaagtagacacagcagtaaaagatggttccaccaatcagagcgtaaggcagctcagaaatgaactgagagaagagcagacaagaccagtggaaggtgttggacgacgactctcgaacctcaaacaactctcgggactggaaggcaaacgactggatctggttgataagaggcacagacagagtggtgatcatgaagacagcgaaaatggcattctgcattccagacagggtgaacttgatgtcccaaaaagagaaaccaatgaagagaccaccaacgataagaagcatgaacttggccataatgtagccgggagaccgccagaactgaatctgggttcgtcgaagaacccatcgcagctgagtcatgtaaggagcagcgtactttcgctgaagagaggggtccagttccttctggggtcgctgagcaagctcctgttggagcttggcaatctcatcggtggtctgtcggtactcctcagagttcttccacttatcgtgccagtctccatcggcagtagcagtagcaccggcaccgatacactcgagaatgtattcggcagggttctcatcgggagcacactttcgaccaccctgtcgctcaaagtaagagacgagggtgttggagttcttaccaatatcaccgaagtagacggtctggccacccttcttcagaagcagaagacggtcaaactcctcaaacagagtagcagaaggctgatggatggtacacagaatggcctggccggcagcagcaaggttcttgaggaactggacaatagcccaagcagactgagagtcaagaccagaagtaggctcatccaagaacagcagcaaagaaggcttggcgacaagctcgacaccgatagacagcttctttcgttgctccacgttgagacctcgaccagtctctccaacaagagactctgcgtaagcttccataccaagcagcttgatgatcttgtcacagtagtcaatcttctcctggtcggggacaaaagagggctgtcgaagacgggcagagaaaatcagagattcacgaacagtggactcagcaagatgcagatcctgctgctggacataaccggttcgtcgctggaaagttcgatccagaggtcggccgttgacaagcatgtcaccagtgatgacaccaaagttgattcgctgagacagaacgttgagtagagtggtcttaccagcaccagactctcccataagagcagtgatagtaccgggcttgacgtaaccctgcacgttatctagcagctttcgagtaccgccagcaataggaatgacatagtcgacattttgccaggtgaagacgtctcgctcttcatcgagggagaggaggcggtccatcttcttctcggaatcgtcagcctgggccttgtcagcaatcacctcgtcaatatcagcaccctccttctgcagctcctcgggaatatggcctcgcttaaacagcagaacgtcaccagaagaggagtggtattggatgtactcggagaaggtgacgttgaagaaaacgaagcccatccagaaagcaaacagaatacccaggtttctccacatgtgcgagaaagagtagttgtacgagttcttgatgtagttgtcaccagtgacgaccagagaaccgggtgtggaaccagagaaggagcagaccttgttggattcgggcatgccggagtagtctggaccagcgggcacaatctgctcacaggtcatgactcggttgtgaaactcgttggccatcagggcctcgaaaccgtaagccacagggttggctcggttcagccacttgaaccacacatgcatggtaggggtggggatcatataaccagagtagacgacgataatcagaataccaataccagccagcgaattggcaacttcaacggaaggagtggcagaggccagcacttggaaaaaggccgtcatacactgggttgtgacgaacaaaatgaacagatgggcaaagaactggccggccgttcggttcaggtgggtcaagaaataaacaatgagggtgaaacagatcatggtaacaagcttaccggggatatcggtcagcagggcctggagggcctcgccggcagggtggtagaacgagtaacttttttgcttcacaataataggtcgctgggagaaggagtgggaaatctcggccatagaggcgagagcattaaacagaagagtaaagaaaagaacaccacctcgagagaatgctccagcggtggactcagtaatgttgtagaaaagcgaaccaatgacgagggcctggatgatgttggcacacacgttgatggtctggtaggccatgtctcccttgagacgctcgaaacctcgctgggtgaggagtcgcatctgcatggcaaaggagatgaggtagggcgacttctttcgctgtcgcttcatcttatccttggacagcgagtcctgcatgttctggaatgtctcctcggcgttatgggaacccacatagtcgtcgtactcggcttggaccactcggaactcgggggaggccagccagtacttctcgaactcgtcagcggtggtgggcaccttgccgaccatctcagggtagggctctcggccaagggggtcggtaacagctgtgaggaactcggcggtagtctgtcgaggagggcactcgtaacccattcgctggaagtagtccttggcgtgatcggcgggtccgtagtaaatctgtcgaccagagtagagcacagtgaccttgtcaaagaggttgtagatgtgctctccggcctggtagatggcaacaaacgacgcattgttgagaatgttagtggtggctcggatggcctgagagtattccagagcagtggaggcatcgagacctcgagtagcgttatcccaagcaaaaatggaagctcgggtagccagggcctctgcaatagagactcgctttcgctctcctccagacacacctcgaacgaaatcgtttccaaccttggtgttgtaggtgtgacgcagaccgaagacggttgccagcagctggacgtagtttttgatgtactggtctcgagtgagtccgtccagacgctgtcgtggggttcggcatccgacagcaaagttaagagtctcttcgacggtgagatgggggaaatgcacgtccagctctccattgtagataatgtccgacttaaagtactccagcatgtccttctggctgagaccgtcgtatgaaatgtctccctccacgccagtgtagcctccgacctgtccggtaatggtcttgaggaaggtggagcatccagatccaggtcggccgagcaccaggcacatctctccggccttgagcactccgttgttgttctggataatgtgtcgagtctgcttcttcttgaaagccttagcgatttggactggcagggtggccagggctcgcagcagctcgtcgaccgaaggaacaaagacggtggactggtcgataccgtcggtggtcaggtttctccagcccacgcctgcagaacgcatgtgcacgccttgctcgtgggacttttgcacaaagccgtcgagaattcgggccaggtcaaaggtgtcttcgttgttcttgagagactctcgctcatcttgggtcattcgacgagaaatctgctctgtgtatgactgcagcttgtgcagcgactcggggttggacagcacccgctgcagatcgttcacgtcccgggaatcggggtccatgttctcgacatcggtgagaggcaccggggtcgccgtgtaagtgttatcttccgaggtttccgacatctgcgttagaggagctccggaggaggaagattcgtgcttctcggtgtggtcgacttgcaccgggtgttcttgctccacgtcccgattgggatcgatagggccgttgtccatggtgcttggagtggtgatatgtgtgaggaagaaaaaagttggatccttttccgtctagactttggaacctcttccaagcagcaaggctagaacggttaacccttccagcaaggttggttgggctactctctccattcaagtaaaatcagcagatagcagcggcaccaggcccgctaagacgccatggtatactcacattgatcgagacacgttcgtcaggtagcttagagttgctacagtgggctacactcttgtatttatttgatcttgctgagctactggaagctggcctcgcactttgttatgcatatcagcccgatccgaaaagggaactttcagatgcatctaattcaaaacatacaatcgccaaacccaaacgaaagctgttatggaagcttgtccgactatgacaatcggacgcaccgtgcaatggcgaagctgtgtgaagcagccggtgagagctgtcagatttgtcctgtacacatgtgccaatgcctcggttggcccatcgcccagcctgtcaaacttagaccctctgccaccgtcgcaatggtttgtcagtccaagtcgcctgcatcggaaggaagcaaccagtttctagcacctttccgttccgctcagccgtgcaagaaaagcaaaaagccaaaggtatgttctggaggagatgtggaagccaaaaaaccttgggtggcttttaaatcatacagtcatcgcagctatcgcttggttcattgtcgtttagcaatacgccatgtgcttggctggcggcgtacattgtagagtccggcatgtgacggtcgcagatggatcaccgtgccgtgagccgccagggcagccagcgtcgcacatttcaaccaattagtcgagatataaatgcaacgttatacaagtatatcccttaaacaggtggggtaggtatgagggtgccgctacgcttggtgttgtatcgctacactacgtagtgcaagcaccaaggtgggtggctctacctgatgagaatgagggatattttgtcaatggctccgatagtggcaagtcgacgttggcagcacacactctgtaacttccacttggggctattatttccccaacatggccatcatcccctccggaacatgtccctctttttatctcactttccgacccgatcccaaatagcagcagcgtggatactttttgatgcttctcagatgcctatttgtaagcgggcctccaaggtcaaggttttttgccgttgagagcttaggtacaccgagaggttgacgtttcgcccagcctttgtgttcgccaccgtcagggtggccccttcttatcgctccggtcaccgggctggggcctctcttcgcttgctgggcccttgttccagctgctcggtatctctactgacgtcaaactcagccgttgatcggtttctcttcccaaagtctactttctgactggctccactgggtgcttgtgtgagagatgaagggtgggcttgtctcaccacagttcctccggttggggtgcagttgtgcatggaacgattggcgcatgggggctttatcgatccatcgatattgctccaccacctctcctataagtacgtactcgtaccgtacgagcaccagtactcgttcgctgaccgcctcaagacaggtctcggttgcccgagcttgacttaaaaataaaaaacaaccaagacgtggcatgacagtcaagctcaataaaagacagacgaccgacgccttcggcacatggatcaaggcactagttagcagaccctacatggcgagaataagacacggttgccccgaataccgcgcccttcctgggtcctcagactggcccctatccgtagctacaagtagctaagagtaactactcgtatcactacctaaaatccaaccattgtgataataataggtctcaagatgaaaggagaccaaacattgtcgcattacttgacggactcacatttctactgcccttcaacctcttcaaagtctcttctctaccttagaacgtcgagatccaaaacctgctgtagctacttgttatcacgctcatttatttatccgatctatttttgtctcgactcttggctatcattggttttggccgactcctatccaacccaacatctctcctgattgaaaaaaagcttcatcgcataaattactgctccaaagttagcctccagttgcctaacctacagctgttggaccaacttgtttactttttttacaccgaaacttgtccacggaagcgccaccaacagaccctcccgtaactctgaacctgagcccactcaactgagcctgtgcacacacaaactgtattcccctttgtactgtaattagtcatctctgaaggggcacagctttgatccttgtagcaactatagtttggtggcccttaaacccggcactagcgactgaacgcctaaaaacaaggacatttcggacttgacaagctcgctatagcgcggaagttggtctgctttcctgccaattcttcattcaatcagctcacccgaaatattggtgacccgaaaagctcgcattatcggactcgtacaagtaccccgatctgcttgctgcagaacacccctatctcggcagtaaccgagaaaccaaacgccgacattaaaaaaaagtcacttcatatgagtccggcattggttcggtacaagtaattaaccaccttccgccaagccttcccgtttcatctttgcacagcgatcagcaaggtgcatccatctatcgcttagtaatctaagagtagaccagaccagttcgtcggagtccgaatgcagctccagcaatctatttacctattttcttcggtgcaacaatgcagccctcaaggtacagtatgtacactttgtcccctcatcatccgagccgcttcatctttttggccttgggcttctcaactcgtcccactgtgttagcttcgatatcgtaacagacagtttcggtacgctgttggactgtacttggcatctaccttgcggagcttggcaaccagttatccaaccgaggttccggcatgaagaatgcttgacaaaagacctcctattccttcgccaccatatggactgcaccaaaactgcattccggtgatgaaaaaaaatagtgagccgcagcaaaattcttgttgagggtgggtagcaacacgtgcgtccgcacaatgaatgttgctgcagcgaaagcaaacttctttcacagaagcacttgcggctgatggctgagctcgtgtgcaacgtaatctcccttccgtgtcggaaaatcaacttatcttattccgctgccgctgtctttgacacagcaaagtgatgcacacttttagccgcatttagaccagtagtagtccatcgtaaccgtatcttccataatctcaaatgtaatactcacctctaccggatgcgtcagacggactctgaaacatactggcccgtcccgcattggccttttggctgaacttttgccacttgttcttcgtggcatctagtgcctcctcctgcttctcccacttgctctttttcttcttgggagccagagcgttctgagactgcagagcaggtcggtcgcttgcacgtgactcagctggtggagctgagggagggggagtcggcgatgcactggatgcgcttcttggaggcggctttggagcgcacactggtttaggaggagctggtgatttgggaacacttgctgggggcggagggacagccaaagtgggcttgacaggtgcacttccacccgtagcagaatcttttgctcccttctcgttgccgtcctcaccctccaccacatccttttcgtcaccacaggcctcctccttttgatcatcatctgcattagtatcatcttgtaacagctgaattagctcgagcaactcatccctcagggttgccaggtcggcgttttctgggtcatccagaagttcggtttgcactgtttccagctgatctaggtactcttggagatcgtcagacatgatgtcctgagtgtgatgtgttgtgtagtggtgatgttcaaaaaaaaatctggcgtggataatgtatatgcatgttcgaactttgttacacgatagacgatacatacccatggctcactcattaatcattaattagtataaataagtacggaaatgtctgtggttcgtgacttttggaggcttgcgcgagcgcattaaatgaagatgacgttgacaattgtggaaatggtccagatactgatgatggtcactccaattgtcttggtcatgtgccatcgagccaagggaaccatcaccatggtgatgaccagcgtcagaaacagcgtggcagcagaaataataagagtcccgctgatctcaatgtggtagctgccgtttttgactgcattaccaggagagctggtaacaatgagaccagacactccgactcccacaagaacgttcagaagagggccaccgaagcaagcagagagagccatcattgggaatcccatcttggcaatggtagtgttggcaatcagatctcccagtgagttaccaaaggcaaacacagtgagacccagaacggggtcagaaatgcccagaatggcacccaaagccttgagaacaccaaccacaacatccgcgatatgagacacccacgcaatggaagtcaggaagccgaagaacgcgaggaagcggtactggccagactgcaccattctgtcgtagttagtggctgccagccacattagcgtcatggaacagataatgcagaaaatagttccccatactccggggacctcatctagcatgagaatgttgatgacgggaggagccagcatggcctgcacaatcacaagaatcttgtttcgtcgagccatattataaagtaccttgttttcgctctcagcagccaacaaagggttcgttgtagcagtgttattggacacaaacgaagcatcatcagaataagcagacacgggctcggaagcattgggaacctgaggctcttcaaccacagactccacaacggggatagtgatggataggaggaagacagggagagccgtgatgacactggacaccattcccatgaacgacttggaccagaaatcagtcagggtagggaacagagccacgacccaagcactctcagtcacctccttgacgttggaccacatgggttcgatggaggagggaacgggtgagagttcagtgtctaatcgacgagtcagaggtgagtgaatcaaatctgaatggttgtgagcatgatgatcctcaccgtcattaagattgttgattcggtctctaaagtcgagggcaccatacagagacggtctgataggcgcagaatcgtgaactcgatgggttgtgtgcaggggagtaggcagacgcatagaggacgttagccccgtatatctgtcttcttcctcgtcctcatcgagatccaaattatgagtaacgatacggggcacgtttcgatgactgtgggaagaaggatgagagtggacaggggtgataatagggctggatctgttatccaaaggtgaatagcttctagactgggcgtgctcggttctaagacgttccacggccagaggggaccgtccacgatcaggcagacgaccgtggggagacaaagaacgtccatgaggagcatggggattagggtggggcgataggttatttgctgtaggtgtctggggactcttgacgggagatctggaggttctggaagcgtcgtctgagtttgtcagagacaagaatccctctctatcgaaaccgtcttgcagaaccgagtttgaagattctccaacctcttcatcttcaatcacattagcctcttgtccagcatcaagaaagaactctcgcgctcggatctcagaaaggtatgcctggcgcttcttggtgtagtgataatgccaggaaacaacagtggcgacgtagatcatgtagatgatgagcatgagaatgcattcggaccgacgtagttttccgtccgaaataaacgccatagtgcacagcacagcggcggtaaagaagccaatgtctcgaacaaacgactttcgagcgaccttgaacggccgggcaagtgccatggctcccacgacaacagcgctgatgaaactggcagcaccaatgagttctccgatggcaagcgaacctgatccaatcttcatggacgagtaggtagagaataagtcaggggatccgtttccaaaggccaggaatgtgactcccgccaacgactcgctcatgcccagcagtgaggagatggtgcccaaattgggacacagaaagtcgctggcggcgattccgagtgtcataaacaatgtcagcagccacagaagcagcatgatcagcaggaagggtcgttgtccataaggcgagcagtagtagacctgcatgtaatcgatgaaggtgttttcgtcttctgagcagtgcagcttgacgaactcgcactggtcagctcgtggaatgtgtcgcacgttggagcattcatcttccgggagaacgtctcttttgttaagcagtctgttggcgcccgagatggaatgggatcgaggaatggccagaacacagagcacaaagacagacagggctgccagagacaccagtgccttccgcaacttgcctcgtatttgcgccatgatgaggttgccggtatgtgagtagagcgaggtgttgttgggagagtgctaccacttgcaatgtacgacgtgctgttgaccagtgacttatgctcgagatatctgatggagtggcagatagagttcagctgtgaaagacgttggcttagtggatgtgagtgtgattatgggactcgtgggtacgcatgtcggtgcttgaatggtttgcgatcatagcaactggttggctgttcaaatccagcgtcttttttttgcaagttttgagcccccaagcctactctatgggtcgtatgtcttgctgctaacaggcgcactctctacacacccaaaactcatgcagtgggccctttattcggtaatcagagtagttgtataatttacagtaccgtgccgtttaggatatggtttgggcgggcagtgcaaaatttgaggatgtgtggagaggttgctattttgcttatcgacacaagttggaccacttttcggcctcattccttcccttgtcgtcgcctgatgccgctagtggcgtcatctatagccccgcagcttgaaagtgctatgaattgtgccttccagcaactatcgccaaagtacaagtaactaccaataatacgcttgtccaagctcaaattcaacctcgacgtaatacgcattttccgtaccaaataggcagccgggttgacttgttttggttattgtgtgtgcatagagttgttctctcacatgcacatggcctacgaggtgcagcattttgagcagcagcatgtcgagattgtaaacaaccgtcctaacagtatgagtagtaattcatggattttacttgggatatcaaactagctcataaggtatataataatattaaaaaagtaaaaaaggtataccaacaagacatgtgagaggaaccttgaacattactgtagtatgtatgtacatactgtactcataaaaaatcaaaaagattacagcacccaggattctcgtatggtctcccactacaatactaactaggctctctggtgcttgactatggctgatcggacgggaagccgtattttcaccaggatatggccgtaaccaaactgcgccgacccggaatcgaaccgggggcccatcgatggcaacgatggattttaccactaaaccatcggcgcgggtaagttgcaaattttgaaatgctggcatctactttcatatatatgcttagtaaaagcgcgaaataaaatgatcggtcatttgatagtactagtattattatttaggattgtatatatttcatgtatcaaaagtatatagtctttggatcgggactgttgagcactatcagattaccccacacaacacaacactggttgtggagatgtcagcgaaaagaagatggaggtttcggcgatcgtttctccactcaataggatttatactagtaagtgtaaccatcatagccggaacaattcctcgatgtggggtgggtataaaacaaactagtcatggatgtgtaagcactggttggttcgtttagactaagaaagcatacggcacttccttccaagtgtcagtatttgtatgagcacttgcttgtgtctcactccgttaatcagatgtcgaatgactaggtgagaaatccttcaaggtgcgataatggacggtacattggctaattgagggccaggtgtgtctcatgaggtgatgtctccatcttttttgcgtcctacagtagtggatttgtaatccaaaagtagacggttcaggaacaggacccacatcctgtggaggcaaaaggtgttttagtatgcatgatgaggggatgttggaagcgctgggcacggataaaaaatgcgactgagggaaattcggttgaaccacccgccaataagacagcttttcggggcttcatcagatttccgaccaccaataacactatctgacttacccctcctccatctctctattgctagtggctgttaaaccccgtcaggtctagctactttcgggttgaagtagagcctaggtgtatagatctggtttgtgcagatattaccgccatatatcccaatttctctgttcccgttcaacgaaaccgttcttttgaatctgagcatgttacatttctgtcatggcagacccccacatcggaagacaaaggcgaatacggtggctttatttgttctttgtttcatgtctatcgaatacgtaaaactgctttatgaactcccctccaaccttgagcatgtctccaatgaatgtattccaagtagcacggacacagccgatgtggacagattaaggagatgaaatctttccccaatgggaaaacatagcgtcgcgtggtgcaatgaaacggggctttcggaagttgaaacaatgctttcggaagttccatgtagtacttaccggtacaaactgtgcatgcttattcctggcagcataaacttgcagcctgacaaaactgacagaataagtcgactataattccacgggtatcgaggcttatcgctcagcctagccgtcacgagaacacggcgtgtcgcaaggctggggctctttgtgagcaaaattcaaaataccagctgcgtctttgggttctaacttgcctcaagggctaatgggtaacatgtagggagactatcaatgtctactcaagggcacacaacgtaggtcttccaacaactatacggtacatgcctcaaccaaatggcccttccagacctcgctactccttcctttagttccctttgatggctccaggcgaggcaccccgcgaacctctcaactttacgcggccgatggcatgcgatctacacaccataatgtagccgcagggagactcggaagatcggtagcccgcgtttttccgacaggaacagccgcgccgagatacgctatgcaacggtcatacgagaaaaccagaggatttcggcacatgaagctgcccgcggacggccatggctctcgcggacggcccagggctccctccgttatccgtgtggggtataccgctgttgcagtgcattctcaaattgcagaaataagtctgagttagagaagagaaagaaaggcagcaactttaagtgacgtaatcatctccagccaagagtgagtctgccaagggctttcaaagcttagacttgtcgctattatgtttccttggcgtttaagagcaacctgcgacaagcccgcttgttttgggcggggtgtagagctcgccaaatgcacgagatgatgacgcaggagcaatcttgggcgcatgttgccaagacgtgttgtgtacactctccacgcggcccccatagggagggagaccttctccgtgctggcggcataacagacgctagacatggtagcacacgagtgtgtttcggaacccttttcgggtggtgccgctcgtcctcttgtctgttcctggaaagaaggggggagaaatcaggccgaactttaccaactctaagcatgtcaaagtcgacacgagacacaagtatgcgtctccaccatgtgaatagatgccacccctggtcggcaaaaaatagcaacctcccagaccctctatagctgcctgtttatgcgcggtgacgtagcgccgtcggagttgccaactcatggacctacctcgacgttctggactactgtagctgcttgtgtttgtagtaaggcctgcttttgaaatcacctgtctcggaacatcctttttcctccccacacaacacgaagggacggctacaccgaactcaacctaaagagccacatgcaccccggacgaccttggaaatgggttgtaagggatgacatacggagatcaacagacacaaaaccaacattcgatggacacacgctgataaacaataaatccacttgtcatttagcatgtcttttttccccatgtttggtgcccttcgacattatctgacccagtaggttcatgccaaacccaccgaagtctgcagctcattgcgtattgtatctacacttccccgcgctagctatctcaaggcctcccattttagcgcaaaggggcatgtcgaggacctcagtaagacgataacacaaagagacccactgcaacggacacgtattatcttcctaccacagatggagtagtcctcgagcagatcattagagttgcgagtaggtagagttggccggcttccttattttggagggtaagtcttgtctggttgagacttcgggcctactttgcatgcagttgccgggtctcgtagctgcagctggttattccgttgctatgtttctgacaactatatatagatggcgatctctctctctagaatggcatactcgatacgtcgttcgccatgtcttcctatccatccgagaagggcggtaccgaggggatcgacagggtccccagcgagactaacgacgcttcagacaacacttccgataacaacggtctccatgagaagccctccaacgagcacgccgaagggctacctcctgggaacgctctgaacgctgatctcgaccccgaaaacccgctgtctcgatacacccgcgatgagctgctggaaatcgcgtctgggtttgctaaggaaaacggaatgggcgacaaggaggacattttccgaaagggcgctctagtggcccaagacccggccaactttgacaacattgacattctcgacgacaatgaccgatactggctgagacgagaaatcacccacaagtgggaccaccccatgaaggtctactacattgtcatctgctgctctttggctgcggccgtccagggtatggacgagactgtcatcaacggagccaacatcatcttccctgctcagtttggcatcaaggaggaggccggtgtggtgtctcagaagacctggcttcttggtctggtcaactcggccccctacctctgttgtgccgtggtttcctgttggctcaccgaccccattaatagactgctgggccgaaaatggaccattttctggacctgtttctggtctggagctacgtgcttctggtccggtttcgtcaacaactggtggcacctgttcattgcccgattcttccttggattcggtattggacccaagtctgccactgttcccgtctacgccgccgaatgcgctccccccaccattcgaggagccatggtcatgatgtggcagatgtggaccgcctttggaatcatgatgggatacgtcatggacctggccttctactatgtgcctgatcacggcattgagggtctcaactggcgtctgatgctgggctctgctctgatccctgccctgctcgtctgtgtccaggtcatttggtgtcccgagtctcctagatggcaccttgctcgaggagaaatctccaaggcctacgagtgcatgcgagtcattcgaaactcggaagtccaggccgctcgcgacctgttttacgcacacgtgctgctgcttgaagaggaggagctgaagcgcggcaagaaccgatttttcgagctctttaccgtgcctcgaaaccgacgagcttcctgggcctccttcatcgtcatgttcatgcagcagttctgcggtattaacgtgattgcctactactcgtccaacattttcatggagtccggtttcggcgaaatccaggctcttcttgcctcctttggtttcggtgccatcaactttgtgtttgcacttccagctgtttacaccattgatacgtttggtcgacgagcgcttctgttagttaccttcccgctcatggccatcttcttgctatttgcaggcttttgtttctggatcgaccaggacgaccccaccaactccccagctcgagtcggttgtattgctctgggtatttatctcttctcagccgtctactcttgcggagagggtccagttcccttcacctactctgccgaggccttccctctctacattcgagatctaggtatgtcctttgctactgccacctgttggctcttcaactttgtgctggctgtcacctggccttctcttctagctgccttcactccacagggagcctttggatggtacgctgcctggaacgtggttggtttcttcctcgtgctctgtttcttgcctgaaaccaagaacctgactcttgaggagctggacaaggtctttggtgtgcccactcgagtgcacatgaagtaccagttcaacgctttcaaggtgaatatccagcgacacctcttccgacaggacattcccaagccccctcctctctacgcccacgaggttggagttggcggcacttctcactaccagcacaagccccaccacaccgccaacctcactccccttcacacggcggagcttgcttaaattattctgtgttactcatttagttaattgtattcattttaccggcaagtccaagtactgtgctgtgcttatagacgtccgtttgtatcgtatggcatagtcgtatcttggtcagtgatcagtagcaatatgcagctcaaactcttggggggtagagaagtccagaggacagtgaggacacttcattcgaggatgcttgggtcgtgtggactggcgaggagacattcgggagagatgacgtgcaacatacgactccccagacctatataaatacacacccacacatacacaaacaaaaggagctactgctggtagccccttgctaggtcagctgcatggtatgtactgtaccccacattttgttgatatgcgcatcttttggcgggatggtgtttaatctcagattttagccttgtgatgtcacaggcacgttagattgccaactaatacaagccgtaaacaaagaaaagaccgcgttcatggaatcgactagctacaagtagttgctcatgtaaacacatgtagcaagcaggagcccaagaagggactcctaagaggagacagatccctcaattgagggcatcgagtgttcgcatacctgtatactgttgtccatgtgcggcgttgggcggtagcagtacaacacaatcaggcacatgtagctaactacttgtactagtatatcacatccttgcacttgccttttaaatataatattgcttggttatgttacgtagctagctattcctggggcatggcatccaaaagcttgcgcatgtcgccccatttggatttgagattggtgtgctgggcatcaagctcgccatgctttccccgaatctcgtcgagctcctgcttcatctccgtcatttgcgactgcagctgctcattctcagcaaccagacgctcgttgtcctgtctgagatccatcagagcctcaagatcctcgtcaccagtgattcgtctcatctcgctcacctgcatgttcagagtctcattctcgtcttgcagagatgcaagcttgaccttgccctgtaccatttcgttagcaacctcaatatgctccttctcgagagccaccagagtcgactcgattcgtcgcacctgcagagtcagttgaccgttggcaagtcgcagagcctcaacctcctccaatcgctcccgctcaagacggttgatctcgagatactcctcctggtacttgtgtagcaacagagggtgtattttcacgtccatggcatcccgcacaaactcgttgactcggaacacatctccagccccctctctatagacgtcgaaaatagactccttgaggaagggcagcagatggtcgaatttgagagccaaaattgtgtcggcgttcttccggatcaaagccactccaaatttgagaatggcctcgataccctcggtcatgatgatgtcaaagattcgtagcaccattgatagagggaacttgtatgcaaacagcgtaaggaaccactgagaggcgtacatggacgacttgactccctggcgggtcaaatggatatgcacagacgggacctggtcttccaacagcctgtcaaactggtacagcttcagatgcagtccgggcatttcctgcaggaacattgttctgagctcgtagtccttgagcagccgcactagcaggcagaaagcgtccacctcgttgagggtcagtagcagaggggtcgtgacaaacgccatgccctgtgtgtatcccacctcggggtcaaacagactgtatgccttgatgacgttgtatagagagtcgggagaggtctccatgacaaacgacgttcgagacagatctcgtcggatggccttctcgtggggagtgctctccttgaggatttcagtgtagaagtcttgcagagcagcgttcttagagcttgtgataatctgccagattatagaccgtaattctgtggggaatccggcgctaatagcctccttgagctgtttagggtgctccttggccacggttgcgtagtcctcaatgacccgactccaaaagtcccagtcaatgaaggggttttccagcgactccttctgtcgcaactgtcggaagtcctcctgcagtagctcgccagcctgcaacaccgcctgtcgctcccgttcctccttttcactcaggctgtcctggttctgttgcattcggctgtacatgagaccgtagccctcggccacaatcttctcatcgaccttggcgggctgggcgttggcacggtggctgttggccagtgccgtgatgttgtcctcgctcttgagactggtctggctcttgttgcccaggaaccacgagaaggctgaccgctttcgtggtggcagactgggagctccctgccgaggaggaagtgtggggggagtttctcctcgagcagaggctgctccaccgtcgccgtgggtggcgggccgatggggtagcggaggaggaggagccgatgatacgggtgagggggtctggtcatatgtggcatcggggaaagtgccaggtgttagcgattctccgtcggagttgagaacgttagcagagggcgacgtggccgagggcgtggtggtggagtcctcatctgcccccgcagctccagggaaagatccaggtgtcactttcagtgacgtgggcgaagttggcttgggagtggcgggaagttcatcgtcgtcggctttggcagtgccaatggagatggtcgatgtgtttccagcaacttcttcggctgctgcactagtaggggcatcctctgagcccaaaagaacatcttcagtgtcctcgtatctgtggtcgtcttcagattccgtttcggatacaagttcaggtttctgggttagtgtgtgaagtcagaggctcggtggcgagaggcggaccttcgggggcgtgcgcaattgcgttggctgcgcctgtttgtgttccttactcacttcactcatggtcggggggtggtgtgcggtgtgctccgtctttgtagtgaggttgatggtacctcctgcatggtcacgctggacagtgtgagtcccgttgcctgagggattacccaaaccttaatttattgtctcaggtgcggtgatggtggtatcctatgtaccagccggtgaagttcggagatggagtcccaaactgaacagactatagttgcccagaccatggcaagggtgttaagtccgagtgcgactaattgaattggtcggaaattgatttatttcgcgtgtcgaagataaaggcggtgtacttgtaattgcttgctgttaaaccagaggttcaggtacaagttcagggaccttgtttggtgatacttgcttaaaaaaaaaactcgtgattccaatcgctcactaatgacacaccagacgtgtgatttgtggcaatgggtcggtgacataaagtgctaaattatcttggaccaaaaagacggtacccacattagctccagttaatttctgtacagtcttttacattcagatacctgaatggcgcacagtatgttccgagtgtgaagctgcggagataagttaatacggtccatagggacgacagcgatagaagaactgtatgtactgtatgtactgtaccggtgatgacagtatatggctgagactactgcactacagtatcgattaaatcattcgtaatcctttcattagttaataaatactgacaatctcaacagaagagtccatgtgagtgttctcctgggagctttcattgctcagagagtaagaagaagcactggacggggactcggacagcgagggaggtgtcgaacacaggtccgaaacagaaatggcctcagttcgagcctgcacagcaggctgcagacgagagccctccagaaactcgttccagttggtttccacgacgctggcagacatgagcgactcggaagaagagtcactggactcctcctcggtgatgactcctcgggtcacgccaatgtccttgagcataatgttgaccttttcagcatcagcattaggaaagtgaacacgaacgttgtttttgttgacagttacgggcagctctccaagagaggcgcacactgtcttgatgtctttaagaagcaccttggtctcctggacaaaggcctgcaagtctcgctccagttggtccagggattctgtggtcagctgttccgcctccagagagagctggggagcaaagttgaagtccacaaatgtgcctgtggaagtaggctccagacaggcgacccaggaagaagactggaagagggactcttcctcggtgacagactcaacctcgacgggaagaaaatatcgggggaagtactcctgggcagcggagcacagatctagctcccgcactctcagctgggaggtgacctccacgatgctctttcctccaaaggccgtcttttgtagcttatggatgcccttacagggcatggccattgtagcgtacaatcttcggccgaagttgcatgtagtatctttgcgttcgaacgccgaactaaaggctcttcgaatcgcgtagcctgccagggggtaggtgattcgccttcggcagcccggtgctcgctggtagttgtagccgttctcgaatacacggctaatgtgacgcgcacaattgtttgagctgaagtgtcgggtgtgcattcgacgggcatgttggcgatgtttgctgaacatgtcaaacttctgacggaacgtcaatggacggccagcccgggcataggacagcacctcacgatgtgcctggagtcgggcctcacatctcagtgagatgttgaaagccaggctctcgtacgtctcgtggacggtgcgggaaaagtcccgggtgacgtcgcgagtaaatcggacgagattcttgaaaaatggcatggccaacagactgtggtgccgttatccacctatggcacggtgtacagggtggttgggtttatctgtaaatatttcttgtcgcttaatatgcggccgggtaacctgagctggagtaaatgtgttaagctcttcgggacatcggagccgacttttccgaccgcccgaaacacgacgaaatctcgtcttttttcctcgctctcgggctactccgcatttccatgtcatttgcatcgaccagcgactttgctctctctcatgtactctccagctatggcagtgcagctggtccaagcgggaacttgagaaacccaaatgttggtggcaaaacaaaatatgcgtcatcgcttgttgaaaagggtttcattccgcaggtactgtactgtatgatgtacctggtgcatgtgaagaggatgggaaagggcgtacgagtacgatggggtgtcgacaagtcgggggccgtgtaggtggagtaatgtaggatgtctgttacacgtacttgtgcaagtacactttcaacacgtcattagtgtgctcaagtacctgtacttgtatttgtacttgtactgtcgccattttccagccagggggagtatgctcagtcaacttagccatcgttgcgtgtggaatagttgtacaagtacaagtacaagtaatggtatgctcacaaagttgatccatgaacgcccagatttccccgaaacgagacacttgcacatggacaacacggaaacaccccgatacttgtagctctccagctctctctccctcgcgtttcaggaacctcgcgatagaggacctttgatcaactaaaagtctaactggagctgtggtcataacaggatcggaagcagcgaccgctgaggtcggagcccatgaaagggatcgtttactgacccataataaaacaataccaaaatatataatatatatgccgctctataatatgaaacatcgtgatgcgttttttaaacacggatgtgaaaatatatacatcccagatagacatgttcgtcaacaaaccctcaactacttgtaccaagatgtataatggtggatgtcacagcaagcatcttccttattatatacaaaaataaaacataaaacataaaacataaaacataaaacataaaacataaaacataaaacataaaacataaaaaaaaaaaaaaaaaaaaaaaaaggaagtaacactcgaaggagattactcacgccctagatcctacctacaaggtgcctgacgtttcaagatgcgttcacagcccccattatccgtttacggcacttcttactcattcgcctgtgcgttcagtacggctacaagtatccccatgcacccgccttagtgggtcacgtgcagaatattgcacgaactacagcagtgtgttatgaggggacaagacagtgataaatctccagtaaaaacttcgaaatccattagcatactgaaatagcactcacacagctcctgccttaccaagtgccctaacctcagactttggagcgttccacgccttagatatcatccccaaggcacgatatgttgctcaaggttttccaagcatcctaaccgttcactaatcacacacaccaaatcacaccaacatgaccgcctggagcaagtacagcgtgcctgtggtggcttctgtcattatggcatcgaccagtgagtaactcgaccttgattctcagcttttcacccactaacacagcctacttttggttcaagccaatcatcatgtgagtataggaactacgaaccggctgctcgagaaagaaacagctacaacaagcgcgtcagctaccaataaccatctcaatcaacagctaaccaagtgaacagctggcaatcgacggaaacctcaagcccggcgtcaagatcgatcctgagattgctgagagcatagaggctcgaaaagctgctctggcgaacgcccagaaagttgagattcctaagggcggtcctctccccaaggatggaaaggagtaattgtgcatatagacaattgatatgttaactgagtggactacccatgatccgaggacgtggtgagttgacaaggggtatgaatctgatgtagtgatctggggtagatgatccacaaaacagatgcagcagttagatatctgaagccatagagctcatgtccgtcctctatgatatatatacaagttgtattcaaaacatactgtttatgtaggtgcctatctcgtctcgctaccagcctccacaaccctacactcttctttcaccaaccaaccaaaaaacatatatacatcatatttacatgagaccgggcagacttatgccggatctgattatttgttcatcttggagacgaagttgttctcctgcataatggccttggctcgagccttctgggcctttcgggccgctcgcacggggtcggcagcaagcttggctttctgggccgcgggatcaagaatgtcccacagccactgggggtattccgagtcctccagggccacggggtcctggccgttctttcgcacgttgcaacccttgagaacggttcctgcggcgacgctggagggcaccttgggctgcgagggggtggagtatgcacgcgagatcacacggaggggggtggcccgcgatctggtcaggagtcgaagcatgttgtgtgtagttgtgtgtagtgacgtttttgtcgttttcgatatgctaagtttttcagttgacgaggaccatgctgagggttagggatatgagggaagcactacttgtggtagccggcaataaagaagtggctaaaatggatatatgaagggctgcaagaaacacaaatacccgcgagtggtttttccgacgtgttttggaatagtttctcaccaaaaaacaaaaacaaacaccaaaaaacatatcgtaatactcacccatattcctcctacactccatcgctgaataagcaccttagagacgcacgagtttaaaaaattgtgaagttggtgcagagtgagaaatcaaagaacttcatagacatccttaagaacacacaaaaccacgaaacacaatggcaaaaatcaagcgaaaagccaagcacaccaagcgagacaaccccatcgcccgaaaggcgtcccaggccgccaaggacgaccgcaaggatgaaaacacacgaaccaccaagattctgcctctgctagaaaagctcaacggcggcaagcccgcagacaagtgcactgccattggaatgatcacagctatggtcgaggatcctaagctgcgacagatgcttctcaaggagtcgctcatccagactgtgatcgacaagctgcttcctgacgcttccgaggaggttgtcatggagtcgtacggcctgctgcgaaacattgtcctggaggagggctacgacgtggccgtgttcatgttccgaaagaacgtcatcaagattgcatgcgactctctggagaagattgtttccacctgccagaacattgccaacggctcccagcagatccccaaaggagatcaattcactctactgtgcgagtttgccgaaaacattctgtctctgctcaccaacatgggcgtgacttccgatgacattttcgacgccatcgcctcttcgccagctggcgtccagaccgtggctgctcttctggagctgcgaaagaccaaggctgagttgaatcccaagttcccctctgctgtgctctctgctgcctttgagtatctctacaccttttccgagtctaaccccgaattttacaaaaccattcctttcgactataagatctacctcgaggataccactctacccatcgctgcccaggtgtttgtgtggggtctgcactacaacatctgtgtcgagagccagggagtaggctctaagggccgagacgcctctctgtccgagattctgtcgcgactgctcatcattttcaactctaactctgcatttgccgacctgcaggccaagcaggatgctggctccaaggacggaactgtggttgccacggacaagaaggacatggacgccattgaggcccgctccaccgtgaacgccctccaggtcattctcgagctcattacagacattgccgaacaggtcacctggtcaggcgtgaccgaggagcccgaggacgtcgacgaagatatggaggttgacatcccccaggacattgactttggtcatggagacaagaacggcgctgagggaactgccgctacttctaccatcaacttgcttctcaacgaggcctctgctgtcattgagaaggctctcacttatgcccctctcgagtcgcgagccatggctgctctcaacaatctggcatggactatggcatctcacgagcccacaaaggactctgagcagtggcagggagccgcccagcagctctggaccaatgtgttccccatgctcgagaagtacgagggcgagcttgctattgactccctcacatctgctgttggtgttctttgggctgtagcagctgctctggactccaagatcaactctctgactgtttcccagtccgacttcattctggcacagattgagcgagtcaccaaggccacggagactctcactgccgacgagattgccgactatcaccagcgagctgttgctctggttggtcttctagcaatggctaccggcaagagtggctctcaagaatccattgccctggttgagaaggttggagagtaccttctccagcttctggaggctcttccgcagacccaaacccaggttgctctacaggccgtggacaagatctttgacatctttggcgacaagtacccctacgatgggcccgtatttgtcaacaagggctacctgaagcgactggagcctctgctgcccaaggttcgacacatggccaagaaaattaacaagaagcagaaccccagtttgcgggaggacgctgatgctgcctctcagaacctgatgcgtttcatcaagtacaaggctgacggcaactagacaggttatctagtgtattgaataaatagattaatgacgatgttgtaatgatagtgactgagtgagtagatataacccgacctttgtatcgtacctgtacatgtacttgtatcgtgctgggtttcctggatgtactgtaacctaattttgaatattatctccatgcatgatattttcgaacactcatttcgatctcacacgaacacacactaacacacacaatcaccacaatcatgacggagctaaagatgtgcaccgtgtgtgcctcaaatcagaatcgatcaatggaggcccacaaggttctcaaggaggccgggttcgacgtggagagttacggaacgggaagcgcggtcagactgccaggtccagcgtacgacaagcccaacatctacgccttcggaacgccatacgatgatatttataacgagctcagtgcacaagacgagcgattgtacacagctaacggactgctgaccatgttggatcgaaatcgaaagatcaagacggctcctgagcgatgggtggaacacaagaacgtctttgacgtggtcttcacctgcgaggagcggtgcttcgaagctgtttgcgacgacctgatggaccggggggaaaagttgcagcgacctgtgcatgttatcaacgtggatatccgtgataaccatgaggactctgtgattggagcccaaggcatcttgaagctggcccggagtctagctgacagcaaagacctcgacgcacaaatcatgggtatcatggactcgtggcaggagcagcatcccaagctgcctctgatgcatgctgttggctacttttagacaggaccagaaggacgtgtatctcactattgtataaattatatatttaaaaatgcttcattattagattatgttgatggtgacgatgatggatggggtttattgtgtagcctcctttcgctttctccacttttcattagtcacatcgggagtgtcaagcatctttcgcttactgatgggaacgtaggggatcttccgagagaagcttccagagccgttgaccaccgccactctgtcgctgtcgccgtcttcagcacgggggaaagtccgttcgcttccagttcgctcagcaatgtgcttcatcatagctagactgagggtgctctggagcatgacgtcgtgccagtgcttgaaattggagttttccattcgctcctggggcatggcgttgggagtgatccattcgatgggctccttgaatgtacagtcataaagaaccagaggaacatcgtgagccatgtcgtacacggggcgtccaggatacttttcggggttcagcagatcggttatcacgcttggtttctcgagtttctggcccaccaggaagagaatagccatcatgcatcgaacctggtgccacaggaaggctcgtcccttgaggttgaagtagtagatgtcgtccgagagctgctcgatctcggcctctaacatgactcggttgtggtgtgccaactgcttggatccatccaccttgcagaagtttctgtagtcgtgttcacccaggtacagtttggcagcctgtctcattagatcaatgtccagatcgcccttgtggaaaaagtatctatagtgccggtattcacaagagaatctggagtcgaatccctcgggcagtctgagagccacagagtagattcggatatctggtggcagcagctggtttagaatgtgaatgtagttgagctccttgttgtcgttagcggcgtcctgctgctcctcgggagacagcttggatcgcaccttaagagcaatgacctgagagaaggcggacacgcctcggtctgtccttccgcatctgctaaagtcgagatcgaatagactggccgactcggggatcagtctgcaccgttgcatggcagacagaatggttccttcgatagtgggcagaggggtgtcttcatgctggacagccaaacctccataattccagccgagataggaaaagcggatcgcgatttttcgaacggggtgccgactaatgtcgtagctctcgtttcgcttggccttggaggccttgaccggcgggtctggcacggctccctgggcggtactagggtccttgccctccagctcgaaaatgcgattgatgaggtccgctcgagtccatttctgatactcggccattctggaaacttggtgtggcgtgaactttagctgtcgtgtcgctttcggagcggaaatcagccgttttagtgcagctatcagagccatgacaagattcgagctgggaatttttcatcactaagttgggagtgtcggcctgcatgtaagctgcacagagtacgaggctaatggaaataatttggcggtgagaaaaaaaaagaccaagcacactcacacaacacaaaacataatgtctaccgactggaaagacttgcccgttgcgccatggctgatcgacaccatggagcagttcggattcaccgatatgacccctgtccaagcttcagtcatccccatgtttgcaggaaacaaggacgtgattgtcgaggcagtcactggctcaggaaagaccattgccttcctagttcctctgatccagcgaatgctgaatctgctgaaggaaggaccggctgtttctggccgagtgtactctgtggtcgtctctcctacccgggaacttgcccgacagacatatgaagtgctgcagtccattctggagatgggatgtcctgaagccgatgctagcgacaaaatcaccctggagaagaagaagaagggaaaggccgcccccaccatgcccaagaagatccgaggccagctgatcatgggtggagatcttccatctcatatggatctgaagaacttccttagagacaagcctcagatcattgttgccactcctggccgattgctcgagctgttgcgtgctccccaaatcaagacatccgcatttgactctctggtcctggacgaggccgaccggcttctcgacctcggctttggacgagacattacatccatcatcaacattctccccaaacagcgaagaacaggacttttctctgctacaatcacagacgccatccagaacctggtcaaaattggtctacgaaatcccgtcaagattgtcgtcaaggttggcggtaagaaggaacagaagaccccgctttcgctgggtctctcttacgttgttctggagcctcgcgagaagctggcctacgctctcaatctgctcagtatctacccctacagaaaggccattgtttacttgcccacatgtgcagctgtgacatactaccagcaaatgttttcacatctcaacgagggcagggaagaaccctatgagatctacggtcttcatggaaaactgccatcatctactcgaatcaagattctcaacaagtaccaaaagactggagcgcaagccatcttgatgactacagatatcgctgccagaggtcttgatattcccgaggttgatcttgttgtccagcttgatcctccttctgatgctgacaccttccagcatcgatgtggacgagccggtcgagctggaagacagggccaggctattgtacttttgcataagggacgagaggaggaatacgtggacctcatgagagtccgaaaggtgaagctgcgaccatacaccggacctgggtcggagctggaaggagagaaactggatcaggaggctacggaactgtacaccaagctgagaaagtgggtgctcgaagacagacaacgccatgaccaggctcttctttcgtttgtgtcctttgtccggttctactccaagcatgttgcccagtccattttccgaatccagtcactggatctgcctgggctggcagcctcttacggcctgttgcgcctgcctaagatgcctgagctgcgaaccaaggacaacgagagacctgaaaacacatggctgggcgaggtgattgacttcgacacatactcgtacaagaaccccgccaaggaggaggcccgactcaaggagctggaggcacacaaggaagccatgaagaacaaggtcaagatccacaagaccaagaacgacgtccagaaggccaaccgagcctggtcctccacgcttcagaagaaggaggagaagtctgagcgtcaccagaagaagcagacacgtatcaacgagaaaatcaagcgggactttgaggaggccaaagatctcaagcaggaggagtccaaggaggttgttaacgactggaaggacatggtcaagaagagcaagaagcgcaaggtcgatctgcctacctttgacgacctgtaaggtatatagacaattatttatgctacgttgtaccgtatgtacgagtatatcctgcctgaaagaaccgaggcaaaccttttgataatatcaaactacagctcaagtacaccaccagaacgggtagaacattccgcaagtacacttgtacatcgtgatagtcaaatgtgcagcacttctgtaccattctaaagtatcgaatacttcacagattcatctacaattacagtaacacactacgggtcaaaaattatggggatgggactgaatagtccaatcgtattagccccggaggttcggcgttccagcctacgtcctccaaaatactatgtaatccgacaggcaacggctcttataatccctctgtgaaatttccacgggtcttgctccaagggtcatcggcactaacttttgctctggctctttcggcggcctcggttgcggttccatcttcaccatgatccaaaggatcaggttgcactgcgcgtatccaacttaatccatcaactttccgtccggtccactccatacttcgagaacacgggctcgagacgagacacgagctcgtcaaagtcaagaacacgagcttgatatgagatcacgggctcatactgtagaaggcgagaacacgggctcgcgatgagaacacgagctcatctagcggacaaattcgagaacacgagctcgaagtgagaacacgagctcactagggacgatgcgagaacacgggctcgccatgagaacacgggctcataggaaagagtcgagatcacgggctcgaatatgagaacacgggctcatcacaggaatccaaagtcgagaacacgggctcgatatgagaacacgggctcatactggaattattgcgagacacgggctctgaagacgaggcacgggctcaatcttctctcaaggtgcgtcgagacacgagctcgaggcggggtcggtcggtggcgctttggctctgtagctcacggggctgcaggcttttatggctctttgctgttaagtcaattgcgaaatcttctgcactagcggctgctcagcagctctttaccgtcttgtttccgtagtatttctggggctggggtgattgaactgtgatatttttccgttttcttttccgttttcttttccgttttccgtagtatccgtaatggttccgtaataattccgtaatgatgacgatccgaatgatgacgatccgaatgatgccgaagtatccacatgatgataatgttccgatgaatcacaaccggcatggggccggagggagaagatatcgctccatcatgcgatgaagagtttctgaagaagcaagagagaagtggtggatgacgaccccttatatacctttggagagcagcaactcatgcacgaggttgtggggaactggcgcaactgaaggcttattgacgatagaatttgggtcccatatcacgttgtgctttgacaagtgggcagtggtcccatgacccaggcagcagcagcaggcgtagcaagcaattacaggcggcaatcaaggggactggtggatggatatgtcggccgaaatgcccaaaaccgtcgtcattggcacccgatttgccctccatcacgcgccatgaaaagctctaaacttgggcttaaatggctggctcgagaccgagatgatgggggaccaacatgtgacgtaaccccaaactaagaagctaacccgacgcatggtttgaggggttgggcggctatgacacgttagcagtattgtagcacatggtgtgtttattggtgagagatcggctgttacaggtgtagtggtctggatggttgtctcggccagccatctgattatccactgattatccagtcttgtgcttgatcggtggagttgcgcttcaggctgatgtcgtagctacgagtatgagtatgagtatgactctgaagtgacagttctataacctacgcacgtacttcttgttagcaagtacgagcacagtatgtattggtaaatacacccgttactcgctcgtactgagtgtctattcttagaccgtctcaggtctcgacatgactccacggacttgtgtcatagtgcagtgcagacgtgccgtgtgtccggagagggacattctatacacgatgagaatgtactcgtactcgtactcatacacacatgtactgtagttccctgatgagacaatagcctgtacagtacctgacaatgtcgtcacctccaatgctcacaatcacctcaaataaccactacactgtcaatatccctcttgcaacgtcgtggacagcgctcaaatctctccaacataataagcgcggagagtgtcgattatgcacgcccctgtgagtcagtctatcatctgcccttatcgggtgattgaggtacttgtaggtgggcctgggatatctcttgaaaatgtgatttggtggcgagtcgaaaatcagcttgtgacacgatatcgaaccgttgtccccattctccattctccattctccattctccaatcaatcgcgacacttccgacccctttgttctgcatcgtatcattccatggccggcgtattggaaggctcgcttcacacaaccgaatctgttgggaccaaagtggaggtccgcacaaacaagagaagacaaacaactgaccaaggctacagtacatactgtacttattgtacgagtaggatcggttccgcaccacactaaagagctgaaaaacgaaattacgtgccgtactcataccgacatatagacactcgtatcaggtatgccattaataaagtctcacgagcacgccatacttgtctactacttgtagctctttccagctccagctcgtacaaaaaacccccccttcccacaaccctccccccaatcctcttcgacccctattgcgagattacttgtacttaatggagaggcaatttcggcattgtgccgtgtttgtttggcgggcttgttaacatgtcttgtcttgttttgtttatcagggttgcaacagagacgggcccgggctctcattggtccaaacggcgcatgtcataccggctccgttagttgaagattgttgacgcaactctaatgtgtcaaaacaaaccaccgctccgtctgtctacaggcactaatcacaccccgttagtttaggggtcgcttcatgatcctaccaggccccacaaaacacgagccctacgcgcagtggctttggtggagcagggtatagcttgaacagttctactactggtacaccaccatggatatatgtccagccacattcccgcaagaccgaaacggaaagaatacgaccgacacggtcggtcgatacgggccagtattcggctggagactgaaagctataaaaccagtaaaaatctttcgtcggccgctggtgggtggtgccggttgggagacgcgttgatggttggtgggccgtgaaagatgcagataaacaggtctgtcgcgtgacccacggtagagtcttgtatagacagtggggcccgaaaaaaaaccacatgggcacactcgcgaaataccgcctgccctcttggttcaatgtaccgtatcacctgccctggaaagtgttggcccaaccccccccctcctccctctctccctttccagcctccccatgcccccgaaactttagtttgagcacgcatccaactaactttgcttcacattcttcagcattctttagcccgtcaactagtcaaactgtatcccccctgttgttgttgacccaactcttccacctacgcgtcactgcttcgtcaactccacaccatggctaaatcaaaaatctactacacgcccagcgacatcactaacacaaaaaccctgcacgataacgccgccacggtgcaattcctcacctcggagctcaccgagagcgcaaaggttgccgctcttgtggccactgagagctggcagcgactggtcgaatgtgtcgcccacacccggggcctcgacaacaaggaaaccaaggcgtttgtcgaaaagtggagccccgacaacgtggacatcactctcagcgaggaattgtccaacggcaagcggttccgagatgaggtggagctcacccccaccggccgtatcaagaagaagcgtgtggtggaccccaacatgcccaagaagcccatgaccgtcttcctggccttctccaccaaaaagcgggccgagattcgagccgctcgactggcccgaggcgagccacctctccagaactcggagatggccaacgaggtggccgaactctggggaaagctgtctgacgctgagaaggaaccttaccagattgagtaccagaagaagctgatcgactaccagagccgaaagaacaagtacattgagagtaaggctgccaacgtggcggccgctgccctggccgaggaggtcgaggaggccgaggaagaggccgaggaagaggccgttgaggaagccgttgaggaggaagaggaggaggaggaagatgaggaggaggaggaggaggaagaggagcccgaacccatcaagtctcccaagaagaacaagaagtccaaggacaagaagaacagacgctcctccaagtctagcaaggagtagactggagtccgcacgaggaatatgtaatattaatgtattagtataatgattgtggttgacaagtgtttggccctgtttgagcggttctatcgcgtcgaaacgcgtgaaacacaatggagatagacatggtacgtacccgtacatacagtacaaaatgttggctcacgagaatgggagaactttcatggagtaatgtgtggaccagcatttgaacatgttcatgcgcttctattggtgttggacgctgtacaatcggggctacaagtagctactgtatggactcatactgtagtccgtttaccaacacattacagcctggtttgaagtcgtactttgagtaccatttacaagtttattaggatatcatgatcagtaagtatacatcacaccaagcttagaaaagcatggcagcggcaacaacaccggcggcagcggcagagacaccgagggcagcggcaccgttggcctgctcgggagcagcggaaggaggagcctggatctggccgtcaccgatctgggagacaacggcaccgttgttggagccgggggcaggggcggcggtgggcttgtggcacttgtcgtcctcgcaagaggtgatggtgacgagctgggtggactgggcagtgacgacaccggtcttggtgacagcggtaccgttagcggcagcagactcggagctgttgtcgtcctcgtagatgacacgggcagcgaagggggtagcaccctgcttgcagtcatcggaagaggtgacggtgtacttgtaggctcggccctgggcagcgcaagcggtgaaggagtagttggggacgtaaaggtggtcctggccgtcaacggtgacgccgtcggttccctgaccctcaccatcctcaatggtggctccgttgccgaactggacggccttgtcgttggcgtaaaggacaccgtccttcacctcgtaggtggtggggataccgccctcaccgccgagaacgagcttcttaccgtcagagacaacgggggtgttctggatgtcggatccggatcggatggcgacgatggtgaacttcttggcggagacaagagcggcggcagaggcgaggagaacagcggagaacttcattgtggatgtttaaacgagtgtgttgattgatcaagggataaagaactagaatagcaggcgacagagcggcactttatagtcctcgggctcctctcccgtcagcaacgaaaccctgcatccgctgcatgtttcttcgtgtcgtgacaacgttcagcactaaacactaggtcctgcattccaaaagacagatcggcgatgtataactctgagcttgtcggatggccacatttccgtttcgggtccacttgaggtgggtgtaatcgtttgatatcgagcaaagaatccgcaccttttatcgatacaagtccatgttgcgcttgagcagtgcgttctacgctaccaaaggctccaatttggcacaccagattcatctcgcttatgcatgccaagggactagcgaaggccaagggatggagctgggaatgcatgtatgcacctataggggaaatattttgatcaaagacagcgagaggcaaaggtggaaggcacgttggtccatctaatgtaacattgatctattttggattgagagatccgagacgaggaatctgagacccgaactctgcgcggttgtgctcgcctgttttggcgcttggcggcctccactcgaacgtgtctcagaaccttaccagtcacgaacaacggactcggacaaaactctcgtgcggtctatgtctcaacgtgttctctcccctcacctccgcattctgcaagcacagtgtgtgtggatagagccattcatgggcccgatatagctcttggccatgcaatgaggcattaaaactacgaacacttgtaacccccgcgaaagataggcatactgttggcatgtctgtttgacggctcgatgatacaagtgccgctactacttgtaacacacctgtaacccatatcgttctacccctgcggaaccaacccgaactatacaagcggccatagcgcctcgtgttgttatttctcacaccacccctgtgcaagtgtaaaagttacccgtcaccttagccactcgttgtggtttttcaatttgaaccttgagccacgtccaatatcgtacattctttcgctccttcgttatgagggagagacagagagagacacacaaacattctagaaagccgcatagcgtgacaagcgcgtacaataagactaccgacagcctgagtctacactttttgcctacaccgtctgcacactggctgagatgtcacacatacaagatgacactacttgtagcccatcttttggatctgtcaaactagccacagtctctagccaggggtcatcgggatgtgcattcagtagcaccatatgagccttaccaacgtctgggttcgaccgtgcgtaactttaccagcgtctctttttcgcgtgctgtagttatagatccacggctccccatggagatgtacaagaacagtaaagaagcaacgtgtaatcgatttgacatggtgctatccggcggattcgcttgcattactacaagcatgcgaaacctccgtgcgcatgggttgctggcaggaacgacgcgcagtccagaggcgtgctggagagagaccaatccattcttgacattggagtatgttacatagagcaatagaccccatctatagactctaataaatgtttgtaacatgtgcagattgatgaataaacatcataacaaaccaacgggtgactgcagacacaacccagtgctggctattttttctacttgaaccaggtacttgtgcaaaaagtggagggtgcatctatctcatcgaagccgagagtttcaagtctccccaggtatgcgtgtttgagggatttagagagagtattgcgaaaatatcgacggatatatatgcggtcaagtgattgaagggactgacacacacacaggtgtgatacacatcgaacaggtactgtacttgtagcagttgagtcgatcgctgtgatgcagaatgccactggtgtaattgtatttgtatggagcaagaaatttcgatgtctcatgttatacaggttaatctggaagcgtatgtattgagaggtataatgtaaaataatagcctgatcggaatgttaaatcgaagtcacgacggcctaattagcaaccgttcttaccgcacttctgctggggggtctggcagtggttcttggcctgggcggtcttggtgacggtcttgttcacagtcttggtaacggtgacgcacttgggagagggaggagggcacttgtgggccaccttggcacacttctttgcgtggatcatctccttgagcttgtggatgtcagcagggttctcagcctcggcagtggtgatgggctcagccgcagccacaggctcggccacaggctcagcaacagaggcgactgcaacggcagcaaaagagaggagaatggcgctgaacttcattttgaaaaagagactggggtggggtggtagttggagtaacgggagtcgggatccttgatttgtgtatcatggaatcgccgcctggttaaatactcatcaatattcacgtccacacgcgctattccaagtgtttgcgtcggttttcgtccatctggaaggtccgacgactggtacctggtcacgcaggggccacccctgaccggaataccccataaaacttccctatattgctcgaggagctctcatatagcctgtcccacgatctcagcttagggcgagggtacagctataaccagagaaacacccataggcgtggacctgccgtccagtcacggctaggtacacctcacccaacatcatcttttcaactgtaccttctaccaaaaccattcttcaagttaaccgacaggttctgaaacattcactcgtacttcatcgtcaccaatagtaagttctggctaagcgaacctgagctcttatacagtcgtatcttacgcaatggaacatcgatctacctggtagctcccggtcgctcctattgtcacatactgtgcctgtatagagatgcccatatagcgtttagttactgcacgggcaggtacacgggtgccgtctggtataactggcaagagttatcaggtaccggtataagtagcttcagtatggaccacgtgacgcgcaattttccatgcaagggcattatacagaagcatctccatgatgttcttccatgcctgtgctggctctaagactacactgagccacatgtatagcagctcctgtgtaagaaacggcagtgttattgtacgcgtactcgtacttgtactttcaggatgaactttcacttatatccatggtattcgtacctcgacttcttccatacgaacaggcaacatctgtcagcatgtgggcaagtccagcagcttcgagtataatcatagagatggccaccatgccaagggaacataccacgagatttaaaaatggcactaatgcacctctagtggaaactagaccagtttagcgccatttaacaaacttcttcaccctcacgtcaaggagtaagctgcgtgtaggctccttgtccacggtcacaagcggttgtctaccgcaggtcgacgttacatcagcttgtatggaagccgtggagagcggatgtacggtattggccaagagtgcgtacatgaccaagaatgtgggttctggatagcctaccagcgtgttcttaatgttttttttttattttattattcagtgtcaaccatgcaccacagctccgtgaatacgtgtacggtacttgtacggtgtctacaagtatacgcagaagagagtacgagaactctcactactgtaggtacaagtacagtgatagcgcccccactgcttgcttgaataaacttgcaccttcttccatcaactgacatgtactcgtaccggtacgtgacccgagaagagtgagacagtgctaacgaagttgagtttgtttggttgcaagaaggacgtattcacctacgagtagcaaaaaatattcgaccgtctaccgtagcagtgcggagacttgaccagaatgctcattgacggtgggcggaactagcccaggacaaggggagccgtttgggaggacgcaggaagcggtttcagcaacaaggagttgaggttgagaaactccaaagtttatgtatgtctgcagttttctccgcagtctcttccacagaccatagtcatacaatttaataggggagtagttattgtaagtaaataaatcgaataatgtaggtctccatcacatcatctccaaaatacagcacgatcaaataactcactcaccgatattatggcttctcaaaaaaaaaaacaagcagggtccattgccgaaaacctaaactctcgttttatcataaaaggtggctactgattaataggaagtgggcagagtcttgtacgagtaccgtacccgtacagtaccggtagcatttatgattacaaacagtgcagactatggattgctatagcgtaccttgtatggtgcactgagtacgttacttgtgctgcttcgaatgcataagataacctgagatatttgaacgccatcaacagcccccaaagctatatacagtagcgcgcgtccatcagacatgcaacaaccaaaggtgcgttgttgctccccctttgtgtaatatactgtagctatggggggcttgttcactcctcgtagaccaaccacgtccaaaatccaacatagtagagtataagttttcggaaagacgtcagccacgctgtagccactcttctaaatacatggccgattatatacaaccataatttctcccaaaattgccccccaaattgcggccttttattcacaatgcacaagatcgtgcctaataattaatatttattaaaactaggttggagttaatgctgtttatcggaggaaagaagagaccgggtcggtccgaaagaaatgctgcgtctgcctcctgtagttgggtcttgtagtgcgctgctgacgggcgagatggacgagcgagctagccgtagcatacgggtgggctgcggctgtcgtctcagtatttttcactctaccagtagttattagtagctttaatatcagatgcatgtctgcgtctctctccatctggtgatataagctactccacgttaggcctgcaacgtacaacggggacatgcagtgcttaggtacgagtacaacatcgtttgacagcacgagacgggggaacgctcatcttgtcggtcggaattaactctaagcctcctgttcatctcctgttcaccctcattcttcgtcaaccgatcttgggcttcttctggtgtgagaagccgtagacccttcactcgttacacgaagcagacagatacaagcacttggccaccgccccgactcgaaagaaaacagccttcaacttcgaccatcgccagagggaggagaaaaaagacgagaattccaccttctgtagctacttcagcaactggcatcatgagcgatgaccagcctctgtacgaaccgccgagtccctacgaggagggctctggtacagagaccctgacaaacggcaaaagctacccttcagacatgccttcatccagctcggagcagcatccctcagctcccaatggatcgttggacaaggatctgttttcggaacactcccgacaacttgaaatcgacaaggagagtctttcaagccaacttccttcataccgacggagaaagcggctggacattgttagcgacgaggaaaaggaggatgtggggcctccagttcacagacacaagctcagaccgacgtcaatggccaaggttttgggactcaacatgaccgagctggaactgctgcggttctacttccatgagagtagcccgattctgtgcgctgccagtggagccaaagactcgatatggatggggaacgtgcctgcgctgtccaacagaagccctgctctcaaacgggccgccatgacctttgctacgttgcatctgggaaagaaccgtcagactgcaacttatcttttgaacgacggaaacgagcatcccacatctagtggtcctcccgatatgaaacaggtgatcggctacgtgccactgcaagaccgtgtcaccgagagactgctcattgagttcacagaaacgctgcgagctcataagaaggagatcatggagacggaagcagaaaactgtgaagctctactggtgacatctgtcgtcatctacctggtggccatgtctcttggccctttaattcctcttgccaactttgacggaggctcagatctcttttcaatcgtgcgcaatctgcgtctcatcacaaccacaatcacaggccaagaacccgtgatccatcctcctttcgaggcacctgctgagggcagcatccggctgcccagggaagaggctctgtgggagattgtcgagttggtggaactcaatatggattactcgcccatcacgaagcgacgtatcaagggcattctgaccaaggaaatcaactctctgatccagctgttgaacatggacatcctcaaccacagtgtcgcgcatttctcggcctggtgcacctactggcagcctgagttttcagacctcaagaacaacgccaacccctacgctctcatgatcatctgctactatgccgcctacacccacatgtggcatattctcttctggtgggcagacagatcatcagaggacgtctactacatcatggatcacattcctatagagttccatgactatcttcaatggcctctggaaatcgtgcagacctacgagtacaactatgaagacatgttgtcagggaagttacgggaaatgactctcgcatagcaaggagacctcatccccacaatctaacaactacggtactgtacttgtactggtacagtacttgtagtacatgaaaaaagtgatccaccaactattctaacagccactacttacattagatacagagttatttattagttgctgctattatttattaatatcattttcttgattatgttgacaaggtgtatctgctttagtcaaattattgtaccgtaactgctcttattctatcagatataaatatttttgtatgccgatattcaatccgccttacatggagtaagtctcgttgcaaaaccgaaccccagtcttcttggcagcctgctcagcggtcacgaccagaccattggggccacaggcaagaatccacttaccctcaggagcgcttcggtcgagaaagtaagcgctggccgtgtctgcgggctggggacggccatcgtggtatgtaatgctttgagaagcttcccgctttccattgtcctggtccttccccttgttcttgtgtgcgcccttggtgctatcttggctgctgctgccttcgtcttcagagagcaggtcgtcgagctcatctcgctctctgtcttcatcttcctggccaatctcctccatctccatatcctcggacaggaggccagcggtgccttcagcgtccttagcgtacaccacaccttctcccaggaagggatcttgaccagtgatgtagatatcggtaggcgtttcacccaagcgcgactcgacttcactgacaccagccttgtttcgcaacacccaaaccagcttatgcgagattccggcctttgcaagggtctggacgacaggaagagcaaaggagatacccgctcctccagcaaatactaggactcggtttgccgtcgagaaaaagtcgtcgggcagagactcgaaggggccgtagacggcaaactgggttccagaagcagcgtgagccagggagaacttggtgggtcgaacaatgagctccacgtgatcgtctgagggcagagacgaaatggtgtatgggtgtgtggaggagatccaggagagtgggtttctgagagttctagagactcgaatatgagaagctgggacaaagaattcgggcagaatacttcgggggaaagtgacacgatgcagatcgggacccatggcttccgtagactcgatctggaccgtgctggatgcgaggacacggtagagcagcgagctgcccatgaagagagcgacccagaagaagagccatcccactccgggtctagcgtggaagattgtagcgatggccacgaaccacgccgacaggtagtggatggtgtagaagagggaatacattcgctttcggaagaagggcagggaggtgaccaccatgaccaggaagacggccaggatgatgacgcccagaaagttgtcgaacttgaacaccttgtagaactcgttcttcttgacgaagtggacggtgtagagaacaccatggacgacaccgacaagcgtggccagtcgtcccagccacttgtggagcggtagcagtttcagataaaaggtccggggcagaggggagggtctgatggcgagaaagacaatgagcggtagcagagcgtagcagagccgcccaaaccgtttggccgcctcgttgagttcctcgacgtgaatgactcccatgccaatgaccagggctgtccacagcaataccgagagccacagcgggagtctgagatcgcgtttcgtgcgtgcccgaacctcgggttgggttaggttcctaaccgcgatgtagcacacgaccagcagcgaaatgacaagcacaaacgtgccgtacttgatgttggcgttgtggtggtcgccatggcgtttttcgagcattttagcgggggcccagacagagtggtgcggaggtggccaactatgggacgtgtagatgtacttaccacgactaggttgtaaggttcacccgtggggaggttatgttgacgaggtcttcaggggcagtgcctacaagtagagagggcaagagcaccaataatgagcaaatatctgccgatgcgggcgcatagcttaaaccggggtttttttttgagcgctttagcgtacaagtactcaagctgaacccgctattggccatgttttcatacacatttctttgctcgcatctgctgtgacatgttgatattactgtaacacggaggatacagccatagacgttaatttataatgtgacgagagttgcagaaaataaagccgtgtcgatgctcgactaagtaacggccgaataagtgcacagcacgggacactagtacgagaactcgtacggtattcgtattgtaggcatactacgactggcacaaacagctcaagtcacaaccgtccgtacaagaagaaattctggggtgatttctgggccgaccggttgtttcaaggtgagacttgggcttgcctcggatctctctccatgcatcacataggcatgatgcctccatatggagagatgtccccggccatttcaaatggtcgcattacggcaaaatggactacattgtagtatgggctacttgtactgtacttgtactggtaccatttcgcatgcaactcggttggcgggtcgctatcgtgtctcattatgctgctctacttgtagtcttagagacctacgctctacagtaacattcactaatcaatttccttcgtaatacctactcctcgacaagaccaatggccttgacggggatgaccttgacggggggagcctcaagaccctccttcttctgcttgagaacagactcaatctctcgcagacgagccttctccttggtatgatgcaaacactccatgtagtcctcaaagttggggagacactgagcccggcttttggcatcagtcttggctgtgcagtgcatgaacgactgccattctgtgttagttgatgaccttcatggtgctgttggtgtcaagacggccgttaggcccgatctgaatggggtatcaaatcatatcaaaacagaagtaacacaaaacaaattgcactcagcccttccaatctgctgccacgtagcatgaccgcagatccaggatcattccttcacaaagtcgctgtttttcaaaccaccctcgcagcgccatgagcgaacctcatagagaccataaaaagccgggaaaacaaaggagacgaagctgctcgatgtaattgccatactcacccgaaaagcatcggtttcgacctccagtcaaactaattccagcagcagtcatgttgtgtagtgttgtgtatggagggtagatttggtcttattggtttctcttgattggcccacagcatatacaaccctaaccttctcccaaccatcaggctgagtaagcagaaataccagcttcttgagaaaagaagatattgttatataaagaagtgaatatcattcaagatgctcttctagaggcgtagtagaccacactttctgtctccgtagatctctaccaccccgtgatcagtggttttgcagaatacgaggactagaaactcctataaatgttcttgattcactgtcaacgagctcaagaatcaatcaactcgcctacgatcgtgcttgagctcgtacttgtacttgtacttgtactgtatgtactcgtaccgctcctacgtatctcaccgacttctgaaatctcacctcttcacacgcgtacattacagaccacgagtacatgtgatcataacaaatagccgtagtttctcggcgataaaacccactgcaagcttctccatcccccataaatcgtatacaaatacctgtaatcgtatgagcgagagccccacaagaccacccatcgttgcagtactccctacattgcgagaatctctactattaaggtaataagggtaatatctccatctcatacccgctgaccaagcacaatagcttattcgccacagcactgcaagcgactggtcacgtgaccgccaacgccatccgtatcggacggacaccacggttgcggaacagcttcctgtttgtagccctatgacgcagtgcttgcataaccgttgagacaagacgagcacggtgggtaatttggagtccaaaagttgtggccaaatgtacagtcggtggcgacacggtaccattacacactgtactgttactactgtagtttgtagtggttgtacggtagcttcttgtataaggactggtaccggtagtcacgagtcagcgatggtcttgtcggtgtactaagcatggaaccttctagcatgttctacaacggggcttgaaaatgtgcgtcaagacgataccggtgggtaaacagctctgtgtcttttcgtatccaaagccagccaaaaggacgctctttagtcgtctcagtctaacgccgctacccaccattctagttaccctctcacgtgccctgatttatgcctcagagagttaaaagcttaaaaaatctgctacagctcacacccaacttagcactcactttcatcattcattttcacacaccacatgtccagcacatacagctcgatacaacgacatcgcaaagacacgtcgtcgtcgggctctaacacgacgccgctggcccggcgcaggcggttcgacgagggcccggccgacccgggatcagcgccacacctcgacagctttgtggtgccccccacccgacacgacgatggcaccaaacggcagccaggacgacgcaagcagcgctggagccacggcgagaacaaggtggcagacctgctgcagatgccaacggccctgacgggccacctcacgcccgagcaggccgaagcgtatgccatctactatcgcattgaagagatcagccagcagctgcgtctgggagatatcgtgccgccggaggacgagcggtcgccgtcgccaccgccgcagtatgattccatgggcaagcgaaccaacacacgggatgcccgatacacacgccagctcgaagaggagcgccaccggctgatcgagcgggcccagcgactgattcccaactaccgcccgcccgtggactaccataagcccgccaagacccaggaagttgtctacattcccgttaacgagtaccccgacatcaactttatcggccagctgctgggagccagaggaaagacgctgaagaagatggagcaggaatcaggcgccaaaatctgcattcgaggcagaggcagtgttaagcagggcaagggacgaacagacatccccttccagtccactgccgaggatgaccttcactgtctgatcatctcagaggacgaagagaagattgctcgggcagtccagctggtccagcaggtcatcgatactgctgctagtgttcctgagggccagaacgagctcaagaggtctcagctgcgagaactggctgctctcaacggtactcttcgagatgacgaaaactatggtggcgctccccagtcgtcttctggagacgagatggacgaccgcaacaagcgacgaaacaacttcatgtcgtctattgtttgccatatttgcggctccaaggggcatttcgcccgggactgtctcgagaagggcaccaacgctggcacgtctgagaatgccgacagagagtacgacgctctgatgcgagagctccagggagaaggagtcattgacactgcctctcagcagcagtccattgctcagaaccccaacactaacaacgtgtccaagttgccccctgctgtgactggctccaacgctgctcccatcaatatgcgaaagcccatgagcgagagaggagggtcgtttgatagatttgaccgaggcggcttcaaccagtccaaccagcgagagccccaacagcagagccaccagcaaaacatgcacaacactaacggaaacaactatgaccgatacgaccgcaacttcaacaactcgtccaactcgtcgcccgaactccctccttggcacagacccacacctccctcgcagcctgctgctcccccgtggctgcgacgtgacaactacaaaaagcacgacaaggtatctgtccagcagtcgatgcagcagtcgccgtggaatcgcgacacccgtcagcaccagcatcagcaccagccccccgtgcaccaccagtctatgtttaataacaaccagtctcccatcgggccccctggtatgtcgtcttctggctttggtggttacggtggcgctcctgctggtgtgcccggcatgtctgtgcctcccggacctcctggtctttctaaagttcctcctccccctcctcctcctggggtgcctggaatggatggagaccagcccattcgtcatcccccgcctcctcctcccggagttatcgggcccccaaaataaaaaaactactaacatgtatactaatggatttggatcttagactcgtatatcattttgtccgtaggcttgtattttgtacaaaaattttgataagttttatatatatatatatattttactgcaattttttccaaccttatttagcagtaattctgaagagcgagtgtctttggtacatcctgtacacacaatgctgtacttgtagcttggtgatagcttggtgatagtggcgcagggtggagtaacatgaataagggatcgcagctagtgttatacaacgattctattatacatatacagataaatacatagttggctcccacagtcaagactgattctgaagcttccattttcgagcattctccaggagcttggagaacgacttgtcctcctcgtcggtggggaagacgtagtcgatgtactcctcgaaggtgccatcctccagctttcgcttcttcttgacaggagtgggctttcgcttgtccaaatccgccttagacttgtcatctccatgctcctcttcaaactcacgccatgattcaaacagaaccactcgctcctctcgcttgttggcggccttgagagcgtcccaggcctcgccaaagatacttcgtgcgcgtgcctttgcttcttcagtgacctcaatctcggcctctccctcgtcgttgtattgcagctcctggtcttcagcaggaacagtgacctcaaactgggcaaacgagatccacaccttgatgtgaccgtgggttcgatcaagaagctgtcggtagatggctcgtgctcggtcgtagttctcctcttcagcctcgaactcaataaaccgtttccacacaagttcaggcatctccatctcgggctgcgacacagctagctcaaaaatagcacgagctcgctcctcgtcaccaagcatctgctccagctccgcatactccatccacggagcagcaaactcggcaaatttctccacatacttgtcgtagagctttcgacaccggtcaaactcacgcagtttggcctccagagcaatgtatcccttgtacagcgcaggtttgccccccgacatgcccagtcctcggcctaggatcttacgagcctctggcagattgccatgtcgaatctcaaacttggcccatagtaaccacactttggcgaatgtgaactttttgtgtgggatgatagatatgcatgttttgtagatttcacgggccttttcaacctccttgttctcaagctcctcccagatggcatacttgatccacagaaagatgtaccgtctccaaagacgcttggaatgtgggggaacgttagaaacagcacgttcaaagatctcacgaatctgatcggcctcaagaccactttcctgacccagagtgatgtaagagaaccacgtatcgtagtctgcagggtcctccttcaactgatcctcgtacttggatcgtcttttagtgagaaccacattctcaataccctccttggctccatactgtttctcaaaggccgtgtagtcagcatacagctttgcagacttgcttttgggcagcttctcgagtccataagtgtacagagctcttgctctttcgtactccctatgacgagtctcaaaactcgcccatccagccagcagactctcatccagaaagtccacgcctccatgcgccatttccaccaatgtgtcgattcccagagcatacacctccctgacggtgtctctgtttcctgcctccatctcaaacttggcccatttgttccatgctggtgcacctggatgaacagtgacatatcgtctcagaatgccccgcgcacggtcaaactcacgatatcgcttctccatgttcacgtaagctgcccaggcggtcaccggcggcctccaatgcatccatctctcaaacacggctctgcagccggcaatgttgcccagcgtctcctctgtagccacgtatgtgaaccacagcttgtcgacacgcggcaggagtgtgacggctctgtccagcaggtttcgtgcgtggttgatgttcttctccttgagctcgcactgaatgtatcggatccaggtgggcacatgcgttgagttgacctcgagagctcgttcaaatacagatctggcacgtgcaaactcccgttgctccagctcccactgcgcgtaccgcatccactggccggtgttcagtcgatttcgtcgcaaggctccctcatactcctgtcgtttgcggccttggtactctgccagctcttccagatcggcaatctgctctgtctgctgaagaggcgtctcctttcgctcatatgcctccagcaaaatctgctctgcagaaatctgcaacgcggcgggcgctttgtttttcacccttccttccataccggtgtggtgtttcgaggtcgtatatggcgtcaatattttttggtgatgattctgcgaaggttttatttgcagtgataactaagcttcgtcgagtcaacatgagatgagaggaacagtgtgaacgcatcttgactagtggaaatcagtatatatagacatatagacaagtactacctccaacacctaatgctaagagatacatttgttttcccgtctgttttgtcggtctattctatctttatatcgatactcgcgccacaatacaggaacaagtattgtatgtaactacgtacttacagaacatactgtagctacagtagctagttgtatggcaaccaaaaagactacaagtattacaagtagctactacctattcacatctatacctaattccacatatgttcatccagtagcacgtagttcacgctgccccatcccacatcctctaatcagtcaattatcaatacattagttgccgcctcgaagggccaggaccagatgcagagaggctccagcttcaatcttgttctccgcaatggtcttctcgtcctggagctgctttccggtgaaaacgagacgctgctgggcgggaggaataccctcgagttcctcgatcttctccttgagaacggagatctgagttagtcctgtttgagtggtgacgggataggtgcgaacaggtccgtaagtgaaccttgcatttgtgggatcgtgatagagaacagcactttcccatgaccttttccccttatcgtgtctcattcatgccaacttcatcgtggcacgcacgcgtgaccacttcgcaacagtccccccagtccctccatctcttcatactcacctgatcttcgggctcaacgtccatctcaatctgtgttagcttcgtcgtcacacactggccgcaacagtgttccaaatgtcatttcatctaggaatgttactgctgggtgtatatcgtggttcaggactcacctcctttccaatgagtgtctgtgttagcatttccaagttagcgcaccgcaagcacgaatctgcggggaggatgcgcacaatgaggtctttcgagtccccaatcatgtaccccgcggtctccccaaatcatactcaccttgatcttgatcttcatgttgcgtggctgtatagtggttgaggttgagttgcagctggaacgagtttaagttgcatgcgaatatatattttggcatgcacaaccaccaaagaatatcgtagtctagacaccacccagaaatgtcgtttccaacaccttccacgtcatcagccaactatgaagaggtctacgagcccagcgaagactccttcatgctcctggacgtgctggaaatggaacagagctacatcaacagccatctgtcataccctgtggtgacagagatcggaaccggatcaggcatcgtcaccaccttcatgctgaaatccgtggtgcccaaaggcgtctttttggctacagatatcagcccctttgcatgcaaccaggttctggccacgtcaaaagaaaacaacggcacccagtacctcgaggcgcttcgtggagaacgtaccacaatgatgagacctcataccatcgatctactggtcttcaaccctccatatgtgccagacgacaagcccgtagaaccctacccggagacagatggtgactgggtcgattgggcacttcttggaggtgaagacggaatgcaggtgacttggaaggtgctactagaactgaagaccatactgtcaaagaacggaatcgcctacattttgttctgtgcaagcaacaagccagaacaagtggctgtcaaaatgagggaactgggatggatcgtgacgcgcattgttgaaagaaaagaaggcagggaacttctaagtgtctacagattcgagctgaagtagtagaccatcattgcatattaattacattttttcacacgcatacatatcattcattcattaatctatttagtataatatatcatctttactcctggatatcggccaagagatccagctcacaagcctcctgatcagtctccttgagagcgtaaacactttcgtagttgtaaatggagagccggtcaaagaaaggctttagctgtgcaagagaggtaagagaaccaatcttctgtccaaaaagcaaaggccgtcgcttggaagtctcctccagatgaagatcatcactgctgacaggcgtagactcagccaactgatccagaataccgtaagggtgtccgtaaatagcatcactggaatcggtgacaaacagccattgatccagctggaaatcctcctggttaagcaccagcacaagatcgagcagcttacaggcactcatcacgattcggttatccgtctccttaccttgcagcagaccctcgaatataacctgcaggttgtgggcaaccagaggccaaatgggaaccagatgagtggcagagaaccgcataacaatagcacgcagtgcaatgaacaaggactcgagctcaatctcatccagaatgcccttgatctccttcatatgaagcacaaactggtcttcctggccagaaagcaacaggtaacacaaacgtcgaacactgttacctcgagagccccagttgaagacaccagatgagccggtgatgagctcagaaacctccttggtgcacgtggaccacttggacagaatctggggccagggagcctcgtagacaaagttgtcctcgatgaaaaagtcgtgaacggcactcttccacaccttgacggttcctgggatctgagtgatgacgccgagtaactcaaaagaccgtttggggatcacgacgttgttcacaatgccctgcaaaacggaactcaccttgtcttggtcaatgagaatcgttcgcagaacaggaaccaccttcatgagagtctgttcatcggtaacctgtccgaccagcttcacaacagcatcagagatttccttgctcacctttcggttggcaaagttgctgccatcaatcttgactccaataatagtgagggtctgaacggtgggagacaagatttccttgtagggcacggggttcagcatgacggttcgggcgaaacccatgtagtccgagtaaatgtcctctacagcgtcgttggatagagacttcacataagccaaaaggaacgaggccgttgacttcttctggtcatctgagagactctgaagcaactggctcaccgacagcttgggccgagagccatccagaacatgcaataccttcaacacatggggcatatcatcctccgaaagctcgatcagcatttgaagaacctcacctcgctcgaaagagaacagcttgtcgagaatttttcgagctcggaatttcaaccgctggccaaggtagacaacgctgtccaaagtgtattcctcggcctcctgtccatcgaccttccgccacagattgaagcagctcttgacggcattctggaaacacaacagaacaatcattctgtagccattgccctttgtaggctcctccagagataagacaccattgaccacgttggtcatccaccccgtggagttgagatttagttcctcctgcgaagcctcgaccttggtgtaagcaagataaagggactcgagacagtattccagacctgtcaggtaaggaataatggagtcagacagaggtgccgtgacatcagtgactgtatcgccaactgcagggtccttctcgccgtccttgtcgtcaacttcgaccagaacctccctggagcctgtagaaagcttctgcagagaagcaacgggggtaccatcaacaagagcacacagtctctcgacgatagcaatgctaatctggaacaaatcagtagagtagattccgagcagacactctaggaagtgaatccatcccgaactgatgataacgccctttcgagaagacaagccatgcagaacaacagcaataaaaacaccgggaatgttcacatctgaggtttcagacaccaaggggatgtccacaggaccgtttccaatgaacttttcgctcttggaaagcgtcatggaaagatccgaggcctgcagagccttggcaagaactgcaagcacgatgacctgaagctccgagtcctggtttaccaagtcagacagcttagtcaccaacacgcgcacaaatacctcccaattggctttggaagtagggaagagaggcgaatcaagcagaatggaacacagcttgagcactgcagacagagctgaactgtatgccagcgtatcaacagcctggaattgcagaaaatgagccatcaggttggcagtccaagcggcataggtggatttgccttcatagtaatcgttgatgtcaaattcttccacctcctccttgttgaaatggaatttggccatgctagaattattggcagaaagaaccttcgtgagagctgagacgtggtatgcgaaaagagccaggtcatcggactcttcaaacagcagcttgccttcaacggttggccggctgaaaaatgcggacttggacagagggtctaggagaagtgagaatagtttatcacacgacccgctcgaagccactgtgttgagccagtaagagccagcaagagatttctccgatgcaaaagccagggaaatcagctcattggacgacacatcagaggcgaggaatttgtttttgcctgcattgctgccatagagctccaactgagaggtaggaagaggaagcaagtcgagatacaggaacaagggtcgagccaataacttggagaagttgggtgccgaaagagagtgctgccaaatagccgaaaacacttgtgacttctcatcacagggtttcgaaaacagaatactcagagcagcctccacttccctgtcatcgctaccgtgaacagcctgaagagaccacaacgccttgaccagctctgcattgtggaaagggccgttgtagtactgtgagttgggggttaatgatgtgaaaatgtatcctaccagagcaagaagattcgctgggaacagcgggtacagcctggtccatcccaggacagccacgggaggcagagaaggcaggggagagctggagaaggggtcgaattgagccactgcttcttcacctgccagctgtagagttttttccagctgttcagacttaaaaccagaaacctgcttggcttgtagctcggaaatgatgagtgcaagcttggagaagatggctgggttattactacattcagcagtgaccttctggaagaactcatcagccaagcgagtggaggtctgtagaagcaacaagtaaacatcagcagctccatatccatcggcccactcgccatcgtagtactcttcgaccttggactcaatagtggacacttggaaatcgccatcagtgagcgtcgaatgttccactggtaaaaatgcccgctcggggatgagttcaatcaacagagtagcaatctcgttccactctttccactgagaaaaacgtccagacagaagatggctcagtagtgccaaaggagcatgcttgacaatcatctcttcgtccgaaagattgaaggtttgaagtgtgaataaagccaaagatagagagccagtcttgagcatcttttgaatgtcggcccaaatgttgattgcctccactgagtcaacaaaggcggaggctgacaacacaatatcctggtagtcaggtctcttttcacagtcgtagacagattggataatgggtgtcagaatctctggaatcacagtagatccaatttcccatcgatccatcaacgagagagaaatcttggaagctctcactggcgaactcagagccaggatgccctggacaagcgcatctcggccgtgtgttgtaaagtactccttcatggaaacatcatcgggtccaagaagccaggcccacaaccttcggttgagagacatgtcctttctgagcacggcggcacacgcgcttgtcatcagcagagaaatgtcgctcttagaggccaggcctgtaatgacaggagaatcgagaggcaggttcttgactaatagttccagaaaacctcgctggacaaggagttggtcgtcctctagcccccgacagaaggcccggatcagcaggccacattccggagtgacagctgactgggcttcgtaggatagactgtgaatgatcttgtcggattcattgatgccctcgaccttggagaactggggcagttctttgtatgcataaaccagcgctccttgcctcttatctggagcggatacaatggtgaggaagaagcattgccaaaagtagggctcatcatggagacgtagcttgagcttctgaatgagatcaaagcacgcctggaatgactcacttgactcgtcgtcgataccgggaagcagtgagagcagcagcggtcgaattgtcgttttgagagtcgcttgaggcagcttctccacaatgtcctcctgaagtacctcaatcaagatgggcttgacgttaatggatgcatatgccatgagcgggagcagtccggggagccagactctgattccctgggccacggggtccaccgatttgccgtccagactcttgtgatagtcgccgatacctcgcagtatctcaaacacctgacggtacacctccagggtcttctggtgcactcctgacggcaggtttggcagcagacaccaggccagtttggaggcaatttcgctctgtagcggcaggtaggatgggttggaatggctcttgagtgctttctgcagcttgccaatgaacgaaatgtagtctgcccattcgtcgaccgagtcccatagagccagcgccttctctagtgctgacgtgtatttcttcatttttgggtctgaattagtaagtcctgtcattgcacacactcgaacagtcgtcgttagtgccggatcatcgctgtggatctcttctaccaccccctaacgcgttcgtgacatgtcctcatgttgaggcgttcagtgctgtaagaagaacagacacaaacaaaaaaagagcttgcgtgccataaccctcttcatacttaccttgggtcgcatccttggaccagaatggcaatggcgatattgaccgaaacatgttggtgatacccttatgttgtagctgacagaaggttcagatacacacagcatgatgatgcgtgtgcatgacaggcttgggtggaaacaataggacacatattgtaacgtcaagaggcgagtgagagtgaaggaatgagtgggtttccagatccgcgaccacccgatatcgtatctctgaacgcttttgtcgtgccacctgactaatcactccggcaaaggtagacacgtgaaactaccctaaccccctgatgggagagtgacacgtttcagatgttttttgttagctttagttaggggattaagtaaattccgtgggttacgtaagcgcggacagacatccggaagaccaaaaataataataaaaaaaataaaatgatacaagcacagtagagagcaaagggaatagtcatgctgattgagaagctccacggtaggttagatttgatgccctaacctattaataggaacccactttcggggaacttgtaattatggaaagaaagacctcacggtgtgtactgttttcaccacctcaacagttggacacttgtatctctgagtaagatgacaaattcacatcttaagcttgcgaagagaagattagcgatagtagaggtatattattcattcgttttcctaaaacagaagaacgtctttgcagatgcgttggctaaaccccatggacgtaacgctcgataagggtgggactaagagcgatagtcggaactgaatcttgacttttatggtgaataagaccatttcataatgtctagcacggccgaaatgattgactatcgaactctctgtcctattatctgccgtagttcatcgccagcgattgggtctcgtgccatctcttcccggtgtaggaaccacaccctgcaggaggctttttacacgaacgcttggctaacttacagccatattaattgattcttgcccctttgggattcaccacagaccgcaatctgcacatgctactccacctgagttcatatatgttcgttaggatgtgcgtgatgagctgtggcccggttgtgctgtcagaaagacgttcacttttggaccaagtctcccagttgtccccgagtagcaacctatagaccatctatgggtgacagagatgatgagtcttaactgtaggttgggcgctatagcggcaacggtgaaaaaacgctcacacagcatatttcttttgggatgctggttggtaagaagatcgagcgaattaaggcccacggctcccgggtcaagtccatccgctacaggtatcatgcagcaacagcgttcattaatgagctcgcggcattgttttgcataccgtcgtgctcaataggctcgatcggtattcactaagtcgagatggaccagtggtggagaaagtagacgacgtatattcaaggagaacccagcctggggacgaggcctagatgatggcgacaaagcggtatgacgacatctgtactaccgccgccttcagcaccatccatggcctcagctgtctcagacctcagccagccacagacagcttcaactgacacaaacagaaggctattttttcatctgggaagaccctgcgtgagttgagccagttactgtatcagggcaaatgttttacaaggacactccctctccctccgccctgtcacgattagcctcgaaggtacaagtagcaaacacatggccgatcgagtttttcgctcccttaatcatgcagatggggtggattaagggggtggcatcttgtttgtatgggtgagaaagtcgcaaaacactggcgcatcttgtggtccaatgtttcacagatacatccagtctgtgggcccacctcagatcctcaacacactttcatatccctcctcctcccccacttcaaccgtgaatgtgttgatttctttttttcctctctcaccaacgttgttcatgccccatgcatcaggactgtgggcacaaataccagagattcgtgatgctctggaccttcctcttctgtcacggtgcgtttatatggataaaatatatccatcaggctcgacgctctcttttcctcaatgttgcatgatgtcatacagtgtcgtattgtatgtacttgcgctagagagaagaaagaaaagaactgaaccattgtatcccctcttgatgatcgcttctttgtgtggctccggacctggacatgcaatcttgtaccgggacactcatagagagagagagagaaagaaagagagaggagatcagggccctcaaggacgcccagatcgtggcccagcaacctccaaggtcaattggacacccactccaacatttggggacctgatctgcacccaaatgggcttagccgcttgaacactacgacccagacgcacgcattccgaaccaactttgttcggaggttcgacacgccgctggaggacctgcaatctcagtttaatgcgaattgagtctgtttgacagtcgttcagtcagtcagtgtcagtcagtgtcagtcagtgtcagtcagtgtcagtcagtgtcagtcagtgtcagtcagtgtcagtcagtgtcagtcagtgtcagtcagtgtcagtctgtcggttcattgcatgtggaattcaggtgtccgatcgcaaactttgagctacgcaaccacagcaaaacagcgactcccttgttggacttgtctcaaagctcgcaaactttctgccagcgggccctcttgttcttatgaaaccatgagattatttcattaggaaagaggttgtgatacacggtggctgtgtgtctccaatctcaatcatcagcagctctgaacctatgagacagaacgtccaaacctaccttgatgggtaaacgtttgtcccgtttgtcccgtttgtccctggtgactcagcaaccagacagaacttgtcacgattcagtacacgcagtccatggctgcccaaacccggacgtcaaccgtgaaatcttccgattatccacgccaagaagccctgcagcccccacaacaacagtacaagtacttttgtctctccatccaggtggagatttcttttttgtcctgacccctacacaaagttacgcatttcggtcgctgattgccgattgccggcttgatgagccctctaattgtccgaacaagctgcaacatcagcattagacagtacggagcgggtcgtacctaatggccagccctgccagctatcgttagaaagagagccaatcccttgtctacagccaactgggctccggctcccggaggttttccttgtttaaccaaataccgacgccgattacgcctacgagtgtttatggcagtcagttttggttaactcaactccgtgggggctctcatgagctgtgctagagcggctaaccgctgaagctgcgcatctggcgattgcacccttgatccacagaaagcgtgcgtgcgaacggcttggatgctacagagcgaaacccccttagcacgtcggtcctcggacgtctgcgatgtgcaatcggtggaaaggtgacgacacaaagaaaggagatcggattgttgtcggcagcggactcctacgaccaataagcgaagatttccatgcatcccgcaggtggtaagcggtggaggaggggggcgaggggcgttcttcatgtgcgacgttgcatgtgggttgtcccaaagttgacttgtgtacatactcacaagtagcgaaagctcgtttgatcccagctgtgggggacacaattaccattctggattacacactccaccgtctgcattccaaacggtctcgaacggtcatgtctgaccaatccctgattggtgtgtgtctgatacccttctggttccatcttgctgtttgctactagagcaaggtagggagcccaccaacaccaccaggagacgttaatcttctgctaattcggtatatgatgaataattgaaacagaacaaccataggagatatcgatcacttccttgtacacgatccctttggtaaaaggctgccagcttgggtgtttccgatctacattcaaacctcctggccatgaaaacttacttgggagctacagggtcacagactttcataatcatttcatattgcagacagggtgggggaggtatggccaggcggacttgtgcttgaacaggaatcttcctgagctccagagcaagtggtcaacaccaaacaagtggttttcatcgatctacagagtccctacagagtccctggatccgagacctctttgttatcattcaggttgtcaatctcgcgaaagattagcattgttttgttatgcctacaagcaacgcacaagccgtgagccgaacacagagccggctgcaacctataatcccaaaatggcagtctgcttgttcctgtccttcatcgattacatcttctctactggacgggcttgcatgcgactttatgcaatggatcgagaaccggaatttctgttcctatgaaactcctccgcggccgtctcgatctccacgatccattccagcctctgagagcagataattctgtcgacactttcggacgccgaaccagtgctcgacaccttgcaccaaaagacaaagtagcaaactacttgtactactcgaatgaaagggtaagattcacgctaagggcttagcatggctgaccacctggttatgataaatacaccgcattagtgcaacgttgatttattgcatcgaactcagacacacggattactgctgccaatgtagcgttgtcctcctggcgatggcgatagatggatgagatattttcggcgacagtggatggtgcatggtgggataacatttcatctccattgactattcaaggccacattcagacatctacgcacttcataagcttggagtgcattgatgctaatcatccatagtggaagacaagccaccttatagcattagacccgcttggcatatgatggacatgccctgtaaatgaggtgcaggtttcgatcactcataatgtgagaaggcaccacaaagaagatttagtgcggttcacctggttgacagtttagactgctcgtcttagcaccacggaactgccctactttctctctttatccagtacctgccttgattagggcttgatccgtagtgtttaggaaacaagggttcgtgtcactagctcgtggatgacgtagaattggcactagcgcgacactagcatggcactagaaggctccaagccgttccattagtgcgctagcgtcgattgccacagctgcttgctaccgttgtcatcgagtccaagtgccaaaaaatatccaggtccacaaactctgaaactttccacgatgttttgttgcacagggcttccggggtgacagaaagtgaggagcctcacgatatgggctgtagagagttgtcgcactctgtacactggagccgcagcgagtcccttacacacatctggactctttttggaggcaaagaatggactgtttccgattagctaggtgtgcagattcggtagccggcagcaccaccaaacagaattcgaactatgccatggcttgagaaaaaaataaaacctataggcccctgagactagcataacatgaaactagagtcgtcgttggcgacattttcttttcggcaggtccggccgtagcctctgccgcctccaccggtacctgcatacgctaagctgggttggtaggaggtagggtaggtccccggctgggcgcgactccgtgtcatttgtagaaatctacacgctgtttgatttaatacaacttgcatctagtttcatttatcgtaacgaaaacactaatggtcgtaaaatatcctaggaggacccaggagggaacctgggaaccttccgaaacgaaacccaaatccgcggctaagtaaaccccatcccaagccacaataaggttggatatataggctcatatgcctccaaaaccctattttacgaacactaatgttaggttagagttcagcacattattcgcttaacagttcatttcagagactcacaccaagatgaagaggagaaactgtaaccgacttctccccactttatgggtggaaatagacacggggaaaagacggggagagacagggagagatgggcaaggagcggagatgggcaagtcgtggtcgactatgccagaccatgtgttcatgacgcgcttgacatgtcaaatttttgacacagactaacggtctctgcagctgtcatcagccaggggttcagtccgtggatatatcggtggcaaaaccacgcacactttattttgggcgaatctacgcggatattcctgcacttgagcggtggaaacagccattcttgaaccacatggacctttccaagagaatcttccgacacactggcattgagctgatcttggctgagatgcgccctaaccactagtcgtggatatacactttctgacactggtccccagcaacggcgaggtactagtgcgatgcctggagacatttgactggtgctacgtgcctgctacttgtactgtatacatgcggcacggggcatcgatgcttctcgcttaacgaaacccgccagaatacgacgatggctgcaaagctgcacagtgcatctgaaagctggcttagtctcggttgtcgggggggggccatatgcaggttcttggcaacgagattggtgcgtagaggcccaagtccactctctccaacttgcgagcgacttgttgggtcacatgttgagtgacaatcgttcatatatccaagggaagcttatgtctggagaaggtatagtgtcggtaccgtccaactgatggcaaggtttcgctacagtgtcaacagaagagcatgtctgttgtcttctggagaagggtcatgtgttgagcgacaaaacaaagataggaggagtatgaaacctaactttctcatgacatgctctagcccccctccaaccacttcatatttgccagtccctttttccatttagtttttatttgtgcgcttacattgcctttctgtctcgtcacttcttaccctctcttattgcaaggttgtgtttgaaagtctgattgaatgaagggaaatgcagaaacaaacgccattgacaaggactggccgaactttgaatgtcgtatccttgcaacttgacttctcaacagacggtaaaactcttccgaaactcgtcatgtatatgccatctatgaatgtcgctgggttttcagactttgcacgagcttgtcatctggcagactgtgaaactccatgtggttcagtctgaggagagcactactctactcatcctcgcggtctctccaccctttgctacaagtccattgttggagacaatcaagtgtaatctagtccgtccctcacacatcttcattgtctgattgtctgattgtctgattgtctgccacgctggatgctcatctctgcccacagcctcaatcattctttcaacgcaacactcacagttaaggccctctaagctcgtgtctttccagttttggttatctttctcgcatctcgccttccctgaagcttcaggcaatggctgcttgaagtctcgttggttcagtttcagggctctcatctcattcactgagcagagctgaagcgggatagacaggaaagagaatggatgtatgagtacgagtacaagtatggactgtacttggttgaccttctcgaaaggggagtcagtgtacccagacatctacgaagacttccatgttgcatatgaagatgcccagaaaggcaatagctctgcgagaccccgaaatatgctgtagaagccagcagccacaagtgtggagctattgcgctgttgtttgggttcttgcagggaacctcattgattctcataccttgataagccgaagaataatcaccctccctccctcggtataccgtagattctgtcagctggaccgggtcccttgttgcatctggactacagctatacatttcattttcagtcgctattaaaggctctttctgagggtggggctgtaggaggtctatgatggttgcgcagtagcggcagcttgttggactagtctaaactgtgagatcgcactaaaagaaacaataattagtactctctaaggacgcgaccatgtattggtgcgatgagcctagagaatggctcttatgcggtccctgagcctgggaaaaagtggtggctcgtacgcagggagacagttcggaagacggaagtggtgcgggtagctccaggggtcccgactatcccgggagcccctctacacagagtttgtcttggtttcttttcgctcttttcttcaccgcggttgtttctttttctttcgttttcgttttcgttttcgtttccgttttcattttctgcgctttgtgcatctttttgtgtgtcgccatggataatggctttggtgggtttttctgctgtttctgtgtccacgcttttttcttgtcccccataataatagacttttgatagtcggacgtgcaggaaagacgaagtcacaaagattgtctgattccagtttgctgcatccacaaatagagtttcgatcagaaaatagtgttattgtgatgtgatcgaaattcgcagaaaaaaaaagagagcgcctggagagggtgttggaaaacctagctgctggtttcgctggaccagacggtctgtggagtcaaaagaaaacaaaaataacacagaagtgggcgtcctcagggagatgggtctgtggggaatatctttccaatcacatggaatagactaatggtggtggtgaatgtagtatggtagctctaactactttagtacagcgaggacatcgaacttttggtggcagcttcaggtgagcatgtttttttgtgttttttttcttcttcttttctgtgacaccgccattgtcgaccccacagcagcagcagcagcagcagcaggtggacgggcactgattggtgctctgcgggagtaggagacgtggtgtcttggttggaaagtcaggctgtcaaagaggttacaacagacaaagggaagaaccctaacccaaaatatttagctctcatgcggacgatctgtcgccttggcaaatttgagttttaatgaaatagccctttgaatgcatgaatgccaaaacgaacctaaaaatcccaaacaaagaaacgtgcaccagaagagcattcgctaaggtcaggtctggtggtttataaagacggcccatgtcgttccaaaagttccgattgtaactaccaactccagtctcagcaaatagaagatcatcacctccgttttgactccttttcccatctttcccatcccctctcagacttacacttaagtcgtctctccaaaactcaccccaacacccacctcccctccaatcatcctccaaacagacaaaatgcaaccctctatggttgacgaaacagtgaattatgtcaatgccagcctgggccttgacatcggagcctctcctgcccttgcagacgcctccgcctcctctaacacctccgtgcccaagtctatctttgtggagacccaccgaccccgaagagcttccatttcttccggtcacattgccaaggctactgctgccgttgccgccctccaggagcagcagaagcagcgacacggcagtcaccgaagcgagtctgagcacactcgactcgttgagggcgcctgtcgacacattgccgaggccgccgctcaggcagctgttgccgccgtaaaggacaacgacgtccaggtcgaggaagactctcgacgaaaggttgtgaagatccagcgaaagcgacgacgaggtggtatcctgggcttcaaggagcttgcagccaagtcgggtctgtctccctggcacttccaccgagtcttccgatccatcaccggcctgactcccaaggcttatggtgatgcttgttggaaggctgttaccaacaagctgtctgaccccgagctgctcaccaacatcaaggaagagcacggtgtgtccaccaagactgaaatggagcctcctaaagagaaccactccgcctcggtcaccccccagcacacccctaccatggcccagtcactgcctacgccttcctacccctttgagcctgtgactccgttcgaggcagccccggctatgacttccaaccctatgcctcaatttgataacactcctttcgagtctatgtcttacgagcctccttttgagacgtgctcctccatgacttctcccgaatctactatgtcctttgatgttcctttcatgtcacctctggccaacaatgccactctgacagcgcctgcatccgcagtttttaacacccaacagcagtactactacgactggtaccagatgccctccgaggtgcctaacatgcccatcggcactccgacaacacagccttctttcacccttgacattcctgataatatgtctgattctactgccacacagcccatgtcttgccactcggcatcgtcggcatcttctcttttggactcggttcacactccaggtgaagagttcaaagatgagatggcttcttggattgataccaaagacaccttcaccgttgaccagaacccctcttatgtcgacatgggcttccagtaagctggcacttactgaaccatttatttattgaatctactcaccctctattgtctacctaaaacaactaacccccttccctcctctcctccagatgccccgatgttgatcatcaatttctattgattttacaatgctcctttttttgtcgctgcagctttgaaagccggcacacttgttgatcacaaccagtccgattcttcttccactattgtttgatatctgtttcttgcccatccatctgtgcagaacagttcacaatcacgtttccaatcaccatctttcgccacatgtttcaccacccttttttcgaacgttcttgctgcttgcgaggaatgcttctcattctgatctttgtacttttttattttatttatttcggacgacgtttgttttatcatgtttttctttccactttttcttttcccccacaaaaaacctttgggcagcgacaccactgtagacacttgtatgctaaccatctttactcccttctctagatccccgattctcgaacagctccgaacccatgcgaagagtccgattccactcagtccactccaatcttcagtcagcccacttccaccaccgaccatggttgccctctctacgcctccctgcgtctttttacgccttcccactcctcctcgctcctcccacgtcgccgcctttacgtttgtttcgccaccgaaagataccccttcctcttcttcatgttcatttttttgactgcctctgaaacacttcacgtgtggacgggtgaccgtttccggtaagcttctgctgctggataactttaactgatctatatattgaaattccacctttttgttatttagcggaaatccccgctccttggatgtttttttgttgttgtgcaactaactacaggactcttagccacggtgcttctctgctttgcttggggaccgcggctacgtgtcttttttcctttctttgtcaagacagtcttggtttttccgcgacacccacatttttttcgcctctttttcagctcgcctctttttcagctcgcttcttttctcgccaatctcgccccctcgtactcatacagtacattactgtgctacgacttgtatcgtacggacttaagtgtacaccccatcccctcgtgcagagtgcagaaacagcctgaaatgttatttaaccgagctcttcgtttgataggtcagtgacgccgccttactgcgctggggcatagagttgagatcaaagagttcgtcttgagagcttgtattttcgaaagggtttgccgaaaagccgccactgcattccaacaactttctaaccaatatataatgtttgatcttgtagaaaatggtgctttgtatactgtagccgtctcccggactccttgaacacctgtagcgagtctaggcacgctctaatgtggcttcggaataatactcggaataaccgtccttcaaaggagaccagaggcatatctacacttggttaaagctggacaaaacttacccaaaacaagcgctcaggatgtacaagtcgtagagttttagatgatacaacaatgtaacatacgtctccaggagcactttgcggtcatgatgcgtttccaccgtcaaacaaggccaaatacgtcctgggtacggcactgctttggaggtcagatgcacgtgcattgcagcacgcccaaacaaacggttgtctctgcgcggttgcgtcaacatatgtacgaacagcttccgtccccaatgcatgggagtgtagaagccctacagaagcggcttgtacaacgttgacacatttgacacattgacactagcgtggaggttgttgtatcaatcaatagctggagtgcaggcggttgcggggctcaagtcctcatgcccacgggagcttttctggctccacagttgccgttaaactatttccctttctctcgacgcccatacaggcacttttcgtttccgtatagcaacctgggttgaaaaaccaatgtctgtaccgtacctccaagttgttgttgcctcgaaagcacacgcaaggttaaccaccgcagtagtctgcagtatcggctctaggtcggcactagcgctagtgcgaggccagcatcgctagatgaagtatcggagcctaaagggccgccctgtcattgtgcgccacgcagcggcctggtgcagtagtgccttctcatgcgcctagtaatgaatgcggctagtaatggaatggtgccttaaatctgaagtgcgggtgcgtccttgagtcacctgtccgttgcagatggtcttctcctcctccgactccggatacggttcaacacgagcttagagcggaaccatcatgccgaatcccctcacctttggctttggtctgcgcctttgatgggctcgtaaaacgctattcccgcctggagaggacaacgaaaagtctacatccgcgatgcacaaaacatgagtgggctgtgacgatctccgacatcacagacttttgggactgcacgtagcaggacgctcaaagtaaaaaagacgcaatgactacccaatccggctcttccgtgcaaatctcagacctcctgtagctgtaatgtatgtagcccacaaaaggccctcccaacaagacgaagaggatcacacaagtcctatagcttcttggttgaatagacataacatgtgcaaggtcaaacgaaaccagagagacggcgggataagtgggtcccttaagtctaggggtctgcaggccaagcagtatacggctctggcccatctctcgtacgatggcgtcactgtggactttgcagccacactgtgggtatgggtacattcctgtccccgggtaccagtacatactgtaaggtactcgtaccagcatgagtagttaccggtatagtacaagcaacctggcaaccattaccgccactttgtcttgttccagcagttttatgattcacggataactttttattgatattaaaagtctccggagctcagggccccttgccaacaatgctggaaataaaccccgcagtctcttgtctcataccgcggacgcacacctgcaaagcggccttgagcgatggaactcggtaacgaacaatggttttatatatatttcggctgataatgtatttgactgcttttgagcccgtgcttggccaaatgaaatcataatctgactttatagaacctcttctcctcgctcgctaaagcgcccttgttcagaaacagtcttccaaagggcggagatgatggagtacattcgaggtacaggtggggtatttgcaccaaccaatgtcatcaccgtatgtactcgtactcgtatgactcctccttggatcggccagtgtcatcaccagatagacacctccggtgagcgccagccttggagagacacacactaacgacagccctcctctcgtcatgttttctttttcccccgcaagaactgctttttccgacgtaactccgccagatttgggggttaaattctacccacctccacatggaaatctactcctcagaacaaacctacacatgttgagagctcagtgtgggcatcttgccagtctcacataatagaagtccaaatgagttgctgtggaagtcgaccatgcttgctttgagacagattgccgccaggaacgaaaagtggatgatatgtgaatacagcggtttttgtcagggagagataagctcctggtggagacccggcgacaagacatggcctgtgtgtacagtggaagctacagtatcttctaaaacatgtacagtatggagagtgtcttagttttagtgcaactcccatgccagtagcatcccatgatgttaccccaatcgcatgatacacttgtgcttcacagtgtctcatgaatcattattaccgaagcatccaagtgctttttgagctctaaaccctggcgatagacaatggacaaaagcaccgactcgccccagcaactcgtaaaatatcccgggaccttaactgtgtcttggacatgtgatggttcagctggaggagagctgtgatgtgctttttaggtcaacattcgagggaaaaagcaatatcacggagatgttttcacggattggacgtggatctccggcggtctcggagtgacaaagtgtttgattcaattgagtacataaaggatcataatcatatgacggaaggaactgtggaacactaaagaattgtctcggttcaaaatgtaacacttgtatgtcgtcttgttagagactccagataagagtgtgtcaaggtgagcacagtctgaagtgatggtcgagggagtcaaagatattcgctggttgttccaggcagtccaaagtgacgcctgtttgttccatatctcattaacggtccagaaatgctacagccaagtctttggtgctcgtatgtcctctgaggcatgcctgttaggatgctcccattgatctacaagcgtgaaaccgtcgggatgtactgtatctagactaaagatctcattttgtaagagtacagcagtttcagcttctgtaaataaccgagtgtatctacttttccgtcactatcgtggagacaagataggacgcaacctgcgctaccagacagaacataatcagaccccgtatgtcgactcgtgtgagacaatagtaatgactaagactatattccctgggtacttctactagtagtgcgtgatggccactcacaatggtacgagtacatacgtacatacactgtcagtaaaaagctcgctaggaagccctacaaacacacctcactctggtcggcacaagtactcgaacatttggattgtagctcgactctcggaagatacaacgttgtaacacccccgactatactgctccaacacttaccatgttaatcatgcattgcactattgtttctattgtttacgcatgccaaacataaaccatctggtcccatccaacggtggtgatccatccaggatcgccccataacgaccagtcgccgccaataacgaactctgtgtgtctgtccatgcatttcacttctgttccaccccgctgtcgagccagatagttgcctccagtgctagcgtcccgccaaactcgagcagtcatgtcgtaagaacacgacagcagcaagtcggcatgatgcggtgaccacgaaactcctctgacgggtagtctgtggcccagaatcaagctcaatggctgaacgggttggttggctgcaggttgagtcattcggatatcgtagacctgaacagaccgatcaacgccacctgtggcaatcactgtgggtctgtacttgttccagtccagcgacagaacctctggtggtcctccagactcggtttgctgcgtggaaaactgttgctggagaggctggggtgctcgagtgtcccacaccttgaccattcctgtggagtgtgcggatgcaataatcgagtctgtgtgaggcgagaatttcgccgaataaatgcactcctgggctgctgcctggttgggggccgtctgacggccaatgtgagctgaagcgtttgttccctgggccggagcaggctggccaagggtcatgatggagtttgtacgttccggcgtccagattttgattgtagagtcccatgaagatgtgcagaagagcgccttgttggccatgttccagttgacagagaagacttcccgtgtgtgctccttgaacgataccagagggaaggcaccggccttgatgtcgaacagcttgactgatccgtctccgcaggcggttgccacgtggttttcgtgttgctcggaccacgcgacatcaaaaatgccgtcctgggtgtcaaactggccttcgcagaccatgcggccctcgggagagatgcccagaatgaagagttttccgtttccgaccagcccgtagttggccgccgttccgaccgcaatcttgtcgttgaaaaacggcgagtagttggccgcgtagccgttgaatccctgtgttttgaatcccaacatgtgtaaagatgtgatttgtgtactagagtgtgtagagtaggtgagtgtgattgagtgtcagtgcttgtgtttcggttgacttaacaagcaattccaacagattcaatgtcgtcgcccttgacaactaccattccaacgtaccgctgatgggtacgaactccttttctgctgcgaacctcgctggtgtcagtgagaatgagattggcctcgttgtcgatggtgatgaggcggccgaaaaaggtgcgctggtcgtcttcggggctgctgtcgctatctggcttcacggcgactcggagaggttgcgaaatgaacctgttgagctgagtctggatcgaagacattactttgggtgggggaatgagtgagaaaaagttaggtgtgtgagtgggttaggggagtgcaatctggtatcgcagtgtggattggtggtggcggtggcgtaggtcacttgtcgtgctgtcggagtggaggaagcggatgcgtactctttttggtatcgagatcactagcacagtaaaccaaagctgtcgctcaaacttgacttgccctatatatactgtaagatgtgggagtgggtgtgtctcccactgttgattgggttcacacattgagggggtgcctgaaaattagaccgggtccggactgtacgcggtcatcacgtacagtacttgtataaaacaaaatgtcgtgcttgtagtgtggtttctgtgttactgagagagaagaaaaaaaaacacacttcaatcactctctagtctcccagaagtgcttccatctcagactcctaatcaatctcatctcactgtttcccaaggttagactctcaagcatcccaaaccgccttgattttgagatgtagatgtccccgtggctcgaggaagtgatggtttagtgtcggacgttggtgtatttatattcttaacaaccaaacgtcacaacccctctgtcgttatactcctcttgacaacgcacgtgtggagtggtatggagcagttcaacccagttatgattggtctttcgtgcaagtacctactgtactgagaagcttgggctcaattacttgggcacttatacacacacaagtaaagatctatttacttcacgaaacgtgtacagaaacgtgtacataacgggcacataacggcttctctctctactcgcaccaatcctaacctcattgtcagtccctcaacctcggctcagccatgctaacggacgtgcattgaagcactgcagaataccatctgcttcggtcatgtatgtacagtgtgtacgatactgtaggtgttgaatgtgttttttttaagctgggagcggtgcgtgtagtgagagagatgtgctgttttttcagcactcgtgcagtgagtactgtacataatcgtactcgtactcgcactggttgtgaaacagtagaagttctattgtacagtagtgttgagttttgttagctttagttggacatgcgtttagctttcgagacgacagaaaccgcaccagaaacccgaatggtgagcatgctcgccaaaagaaagccatcgggccattaatggcatgactgcgtcctatataacatcaaatcactcacttagattcaacccaaagttggtttcgtctcgacccactttgaatcaaaagtgacgtcacctctccaaccttgcaccacccagtcagaagcggagcctgtctgaagatgggtacaagatatcgtcccatcaacaagacggatctgacggtgtcacctgtgcgatataagtactcgtactagaaccaagacaaaaactgccgcatctgaccgtctgtctcctcaccgacctgaaacccacggaacctactcgacttcaaccactagctactctgagcgaaaaaccggccgccgtctcttgtctgtatcaaaatgcggtctgcggctccccatgtctcacttttcaaactgcaagtgaagagcggcgagaacgaatgaggagctgttggaggtacgcgggacttgtctgtagacggtgtggaggacgtaggggaaactatttgcaccccgagccgtccagcatctcgaatgcctcctcgttggctgtctcaggtctattggcacggatcccaatttggaaacacatcaccttttttcattcaacccaaaagtttatcagtgaggctatttttttggacgagacgggcctgatccgagccatggcagtcatattcgaggcatagctgtgaagacatgtacgaggacaatgcgaaatttgcatctgtatccacatccgggctctttgagagcaacgcacgctcagtatttctacacgtacatgcacaatcgtcgacataaactactgtactctgaagatcaccgcaagcaaatgtcactagctacagctacgagtgagataccaccacagggacgtggaatatgcgactccgatccactcccgctaaaacaatgtgtccaattattccgaaacctgcttttggacagctgatggcccgcacgttgcatctactttttgccgcggcctaccccggcagcagcttgcattaatccgtgctgggctggtgggatcgggtcgaatgggagtgaccaagacaagagatgcaaacgggtccaagtctccgggtgaataatggggccatgtgtcgggttggggctgacttgacctggatttggagcggccaacgaggccaaaatcaacgtgaatcgcgcccacagagcccacaatatccctgggtcgtgtacgtacgatacaatactagagccactagcgtcaacttaagtctcgagtttgtgcggggaagtcacaccatagtgcagaatgaccaaggagcggtacgcacgttaccaacactataagatcgactagtctggaagaggtggaagtgaataacgaacacagaggggaaatacgatggagatattcccctcccctgggcctgtagaatatggctatgggtacaggacgtgcatagtcctcgcactccacacaagacccatcaggcccccaacaggcagcccaaactttgagccacataggttgaaactctacctgtcaaagtgactgtacttgaacactgcgagtttagccttaatagtgaggtttgttcccattgctccgctattgacaccacaacccccaactcttcctctttctctctcgcaacaaccgattccaacatgacgagggacacacgaaaccacctgctgttcgaggtcgccaccgaggtcgccaaccgggtcggcggaatctactcggtcatcaagtccaaggcccccgtcaccgtctacgagtacggggaccggtaccacctgattggacccctcaaccgcaagtcggccgacattgaggtggaggagatcaccgacgagtcccagattcccgaagccatcaacaaaacactaaagtccatggcggaacgaggcatccagtacgtctacggccgatggctcattgagggcgctccccgagtcattctcttcgacctgggctccgcctggggctaccttcccgagtggaagagtgatctgtggactgtggccggtatccccgcccccgagggcgacaaggagtccaacgacgccgttgtgttgggctacttggtggcctggttcctgggagagctgaccacccacgaaaccgagcgggccgtcattgcccacttccacgagtggctgtccggtattgctctgcctctgtgcaaaaagcgacgaatcgactgcaccaccatcttcaccacacacgctactctgctgggccgatacctgtgcgccggctcggtcgacttctacaacaacctgcagggcttcgacgtggacgccgaggccggaaagcgaggcatctaccaccgatattgcattgagcgggcggcttcccactcggccgacgttttcaccaccgtgtcgcacatcaccgcctacgagtccgagcacctgctcaagcgaaagcccgacggtgtggtgcccaacggtctcaacgtggtcaagttttcggccatgcacgagttccagaacctgcatgccctgatgaaggacaagatcaaccagtttgtcaagggccacttttacggtcacctggactttgatctcgacgacactctgtatacctttactgccggccgatacgagtaccgaaacaagggtgtagacatgttcatcgagtctctcgcccgtctcaaccacagattgaagagtgagaagtccaccaagaccattgtggcctttatcatcatgcccgcccagacctcatcatacacagtggagaccctcaagggccaggccgttatgaaggctctggaggacaccgtcaacgaaatccagcagcagattggccgacgaatgctcgaccattgtgcccgccacaacagccacgacggaaaggagatccccggcctcgaccagctgctttccccctccgacagagtgctgctcaagcgacgagtgtttgccctcaagcgagaaaccttccctcccattgtcacccacaacatggtggacgactccacagaccccattctcaaccagatccgacgggtacagctgttcaaccggcccgaggaccgggtcaagattatcttccaccccgagttcctcaactccaacaaccctatcctgcctctcgactacgacgactttgtgcgaggctgtcatctcggagtcttcccctcctactacgagccttggggatacacccccgccgagtgcaccgtcatgggcgttccttccatcaccaccaacctctctggtttcggctgctacatggaggatctcattgagaacgcctccgactacggcatctacattgtggaccgtcgtctcaagtctattgacgagagtgttgaccagctaaccgactacatgtttgagttctccaagaagtcgcgacgtcagcgaattaaccagcgaaaccgaaccgagcgactgtccgatctgctggactggaagcgaatgggccgagagtacatcaaggctcgacagctggctcttcgacgagcctaccccgaccagtttgaccacgaggagaaccccttcgaagacgaggagcctctcaagctgactcgacctctatctgtgcctggatccccccgtgaccgagccggtctcatgactcccggtgatcttggatctctgggtgagattggcgagggtcttgacactgacgattatgtgggcttccgacttccccaggatgatgatgacgaggaggagactagctaccctgccactctcactctagccggtagcagaaagtaggcagaagttgagtgtttgaatgtactacttgatagtagggagaaggaaaaacctggtaattaatatattgtcatgataacgatactcaagaagaggacgagtgatgcagcagtggaacgagtagttcgatgtgaggcaaacgtagcctgctagttacgtaccggtattggaaccaatacgaaagtgaaaacgcacacatgttcagatgttcttgcatcatgaagtgtcaatattatctcaccatgtcttgaaatagtacagtaagcaggtttagatactgttccatgttgcattaatacatcgtcgagatacaattatgatatagagctacagtatggctctgaaaagacatgtatcgaaagtaggatagagtctaagcacaagtaacgagctctgcgttcgattcatgtctcaaattgtatacgcatagccatctatgacttgcgtcaccgccgtcggttgtctactttcttgtctcattcattgatgatataaataacctaatcaacatgctatgttctcgcaacccgctcctccttccatctttgtgctctctcgtgtcgcagatggtatcgtgagcgagcctgtctgtagtcggccacaaattgggccacgtcggtgctatcggatcctagaaacgactctcgaagaatctcactaagctcgtccgattccacagctgaatgggtcatactcgactgtagagctggacttgaaaacggttgcagagcccggtacatttctgcctccagctggacccattctccttccaatttcttgcttgcagtcaccttttctcctactcgttgacgcagttcaggaagagtctcctggtactgttccttgagtttttgtgctcgctgttcgagatctttgagcgcgcgtgtctgtcggctgtagtctccgccgttctcggccacaattgagcccttgagcacgtcctgaggcacactggaaatgtgctgggtggccagctcatcgagatgcgacagtgtgtacggtgtggagttgctttgtgcgggaactggcgtggcttctacgggtgtggacggagcaggcgaggcaggagatcccagagcacctcctggcggtttcgctgggagcggcggtggttccattatggtgtattgtagtgttgataacgaacctgcgatgacgaaacttaacatgtggggttgcgcatcttgcagtcaatgagctgctagtcaactatagtttcaattaaatagccaagtgagttacttaaaactgtcgtcaaatggtcaacgatatggacgaagacagaacttgatctgaactaccagcgacatatatagtcgtataacgtagttgccccaacctcaattgaacagataaacacaacttcatgcttatcagcgggtcgtacttggagtgttgttgcattgtacggtgctagtagctatgtttggttgcctaactgacgcccaaccagacgacagtacaagtaaaaacaccggaaagtggttgccctgtactataccaatacaatactgttgagcctttgaattctgtcacaatactgagtgacagactgccagtagttatttgtaatggttacatatagacagtgtactgccctctcctctcattcaccttctcgcacacacaccgatagatgctgtacctatataccctagcggtccaagcaccgatcgtcgcggatgtactgtacccgtatgtatggtcagatctgaacgccacaaaaatggtggtcggaaaagaggccagccattggggggcaaataccggtcatgtgactctgtgtagccgcttgcacgtgacttctcttgcccacaaccatgactaatccggcgctactaccctgtcacaatacactccatgcctgtaaccaaggcaaccctcccagtcaaaatatacggccacgggaaggtaaaaaaggtacttgtcgctacccttgccctgtatacatacaacacatgcatatacaggaaatacacacacgcagacattttgttggacagcgggtagctactaacaccactcttctcgaccgacaatggacatcatcgtggccattccgctgcggtacacgtacctgtacccgcccacagattacatgtggcatgtgggaaacgtgtttcgaccgctggatcaggaaacagagaggtttcgaacccgactggcagccaaaccagacactaaagaggtgctggacaacctggtgagcctgcgaaaggtcgtttccgagatctccgacgtgaaggccaacctggaggagcgtcggctggttgaaaacaccgtcacagtgtctctgatgggcgctcgacaagcggtccagaccgaacgaacacggattctgagagcatacacggctgtggctcgaggccatgtggcgctggaggatcgagtggtttctcagcgaggagatgacctcaaggaaggtctcacggaaatcgccacctactgcaatgtgtcgatatatgtcaccaacaacgtcgacaaggtgacctatggtctggggtactctggaggctctgtgtcctcttcggatgctcagaaacccttccacgtgctcatctacggcgaccaggagctcgttcagtacgcccagttgcgagtggagattctgatccacaaactcatgggctccttcatcgacgccatcgaagtgcccctctcaatgcagcctctgattgccggatgccagctgctcaacgtcaaaaacattgaggcccagagccattgcaaaatcctcttccccaattggctacccgagctgttccacgtggacgaagagatgaacctcaactacgatacggtctttgttgtgggccctacacagcatcatacacttcttgccaagacgctcattgcagagatcaaaaacaagacgcaaacaatttacaaggactgtttgggttcctacgccaaaatcgacctcatgtgtctcaagtaccaacagcgactcaaggaggtgatgcagaagctgggagctttcatccaggtgccctttttgggtgcctctagatccgtcattcgagtgacgggaatttcagatacccatgttgaacaagccattgccgaagtaatgcttatggcttctggttcataccatgccggcttttgggcccataccggccaggaagaccctgccacaaacacttatgttggagtcgatgtcaagtacacagaggactacctctctttcatcgatctggttgctggaacctctggagctactgtctcatgctcgggctcttcgtttgaagtgtctggattcaaggccgatgtcaagcgggctgtttctctgctggccaaggcccctttctggcccaacgcccaatgccagctgcggttccgactagaactacctctttccgagtttgaatttgtcaccggcaagaagaatggaaagattaaccggatcatggattcgtcgaaatgttttatcaagctgtctcccttccacgaatacaactttttcctggatattgtgggcgacgacagtggcaaggtgctgaccggcgtgcaactgctggaagaggagttcccctcagaaacgcagttttacattcccgaaacataccacaagcaagtcatcggaagcggtggccacctcatccagacgctcatgcgaaaatacaatgtgttcatcaagttcaccaacggctacgaccgtgcccccaacggatactcgcaccaccggttcgacaatgtgctggtgcgatgtccgtctaaaaactcggccaacattgctcccaccaagagcgacattctggaaacggccaccaaacgagccggcgatcacggcaacacattcatcaaggtgtcgcgttcccatcgtcgcattcttatgatggagaacgatctctttatcaacattgccgaaggccagtggaacacgtgtgtcatcttcccgtccattgagcccagcgacatttgcgataacgacgaggtcgagattcgaggtcttctgggctcctccgcggaagctgctcacgtgatcaagaactctctccctaacgactacgagtttaaggtcgcgtactcgaaccgttttgcagaggtctgttctgaagacaaccccgagttcttctccaaaattgtggttcctctgcgagttgccctcaaaatccatctccaggtctaccccgaacctcgagtgatgagtggacagaatctgctgggccagaccgactacgattctccccgataccagcgaatcgttctgtcgttcaccttggaacatgcccctggtctggaggaggccattctggctctgaccacctatctgcgtgagaaggagctcgacattatcgatcgaggagatttagttcaagacgtgattcgacagggttccgtgcctctcaatacgggttcatccgagcgaattgtcgaggaggagcacaacgaacaggagccccgagctgccaagttctttgacgttgttcctggagactctcgcgacagagactcgcgtcccagctctcgtgatcacagcggtccctttggtggcagaggtggacccggcggaggagacggaggataccccaatctcccatacagagacccttactaccagtaccctgaccaccgcgactacgaccaatttgacggtcctcccggccagcaggagtactacgaaaaataccgaaacccccggttccgaagcccagttcgaggcggtcctcctggtggaggcatgaaccgagactcgcgagatcagcatgaatacgaccaatacgcccagcagcagcagcagcagtactacggtggtggcggacgaggaggaggaagaggaggtcctggacagggtggccacagtgggccccctggcggcccttacaatcgagaacagcggttctttggaggtaataactcggcacctccgcctggtcctcccggtccgcctggaccccctggaccccctggacctcctggttccaatcctggctccgagcagtctggcgatttccgaggacgaggttacaacgatgaccagcgtgaccggaagcggttccagcctgccagctactattgataataatgatacctatatttgatgattgtatgtaaaatgatttccactgacccgtagtagttacaatgtgatgatatcaactgattgagatatgctgtattatgtgatatggttatgtaagcaaaagtatactgcaagtgcaaccactaattatactacgagtagcgttgatttgtgtgtctattgattgtgagtatatcttgcagcattgcacaagtatttgtagcaatgaacgagtctcctatgtatgaattcatggattctgagatgacgaggtgtgttcacaattttctttagtaatcctgcttttaatacatagcgtttagttgacacccttctcactatgtaaactctaatttcgtcccaacctccaactcactttcatcgcgtcgataacacatcaccacacattcactgaaaaatgcctatgcccccggttggaccgcccgtgcagggcctttcgcatttgctgccccatcagcttgtgcacgcgattggcgagattggcgccgatggcaagtctgcgcttcacgacgaggtcgatgtcgtgtcgcctcgagacattgccgccatgcgatacatgcgtcactacgagtggatggagcttgtgactggagccacgagtgtgggcgccaagggtctcaagctcactgctcctcgaggtatccccgtttacgacatcaagaagaagctggaagagacacagaaggaggttgaggagctcaagagtgagcgacccatggacgttgatgatgagaagagcgagttctacaagaacgaaattctgcggctacgagagtcctttggcgacgaatccgacaccgacactgtccagcgactacacgagaagttcaacctgactgtacacgagtctggcaagctgcggcctgtcaaggtggacctgtctgtgccgtccaagcgacgaagcgacgtggacgccgcacgtatccagcgagccgagcagctcattcaggagcgactggggccccagatccagcagcagcagcagcagcaacaacaactccagcagggccaacagcagggccagcagggtcagcaacagggccagaacatggatcagcagcagcagtaccccatggacggccagcagcagcagcagcagcagcagcagcagcagcagcagggccatagaccacagggtcagatgcagcagggacaaatgcagcatggacagatgcagccgggccagatgcagggcatgggccaggatatgggcatgcaaatgcctctcatggacgacatgctgctcaacgacatggatatccccgaccacgtcatggagcagcaaatggctgaccagctgggaggcgaaatgatgggcgacggtctggatatggacatggatgttgacttggatttgaactacgagtaggactagaaaggataggattatataacaaatgtattattattgattggatggatgtagagtgtacgttgatgtctactcttggtaaagtatataaagggtatgttctatctctcctgaaacatgtctgaatcagtataccatgtcgcagttggctaactcatagtgaggatggtttggaatggacttgtattgtttacttatcgagatggtggattagacatttttggagcgacatttctacttcaattcaagtggtaagtgaatcgcatgtaccgatgataccatattgggcactctatgtcaacttatcgggcttaccaggttcataggattgatgtatcatagcagattaacgagagctgtatgcaaaaagcaattcactggtacaatagatgcaccattgtagtctctgtatcctgaatctctctctacggcattgatttaacgacagtcagaaagagagtaccttgaagccatgttggaatgtatcttcgtcttctaaagtccccgtcaccaatcatacagtagcaaataaccgtgggatgttctcctatagacaatcgcatcgatggctggaaataatggatgccatagcaatggacaaggtgtctgatggcttcgttcgacgaagttaatgctgagagccgcgtaaagacacggattaactgctggaagctagagaagtaagttctttggtttctccggtggaggaagggagactactggacgagtagttgtgctgggacagcgtagggcatgcgtacatgtgctacttgtactgtagcgtacaggtctcggtctaatgacttgaaccacggctgcaccatcactatgactgcgttaaatgcacgcgaagatgtggttttacctgttcctgttgcagccgtggggggtcaactagagttcaccagggacttgtcggccgttaaagagtcacgtttattttgggggtctgtgtcgatcatttttggtctggaagctccgtggacggaagaggagcgtgacctgtgacgtacaagcgccgtcgaaaccacagcgattcgcgctggtcaatcgcagccacgttcgccttccccatggctagcgcaattaaccggactaagcgcctcaccccacaatgcggagatacggcactactgtagtttgtaagcacgtatatgggggatgcagaatgcgcgaaagaggttgtggttgtctgtcccctgctcatgtcggcattgaaattcacgcactagagctcgccattgttcatgtggtagccccttccagcacggctaggaccagacacatgcccagatacggctgagactcggcctatcagctgtggcgtagttcgttctcgctcgcttaggtcaggtcctgcctgggtcacgtcatggtgcttgtgcaaagttggtggattgccgtggggggtacagtcgaggcacagttattgcatcataggcgtgggaggcgagagagggagacgggcccaagacgcacgggtatggtgggtgcaattggcgggtaaatgggcagcgggttgtttgtgtgtgttcttcgcctgtgtgggactgtttttggctcttatttaaagcaattcccaccctcatagcactcctataacccctcttctagcctcttcggtttgctatctgcatattgcgattgcgtcaggttgtttgcgaaaagctaatgcgtcattattccgacgtacgacttaattatccgacataccaggcccggtgtgtcacctggtgagaagcaatggagctggcgagaatcacaggttgtgagccgtttccatgccaccactttcctggccattgtttaatatctcaagggccattgcaacgctctcataatctcttgcaatagtccacctcttctactgagttccataacgttaaccttaggcttaggctgggtgtggtgtgctgtggtgggtggatgtacatagcgaggattatatatagaggtggccttcccccttctcttacgacctcatctttcttgtttatagctcaattgtttgtttgcaacaccaattgaacttttaacagacacatcacacacacctacaaccaacccagaagacattcacaatggcaggcggacccactctcaagctcaactccggacacgagatcccccagattggtctcggaacctggctctctaagcccaacgaggtcgccaaggccgttgagtccgctctcaaggacggctaccgacacattgatggagccaccatctaccagaatgagaacgaagtcggtgctggctggaaggcctctggagttccccgagaggagatcttcctgaccaccaaaaactggaacaacgcccgaaccaaggagggcgtcaagaagcagctcgaccagtccctcaaggagctgcagaccgactacgttgatctgctgctcatccactggcccgttgttttcaagaccggcgaggagctcttcccccacaacgccgacggcactgtcgcccttggcgaggtccctgtcgaggagacttgggaggccttcgaggagctcgtgaaggagggcaaggtcaagtccatcggtgtctccaacttcaccgaggagcgaattgagaagctcctcaagaccgccaagatcccccctgccgtcaaccagattgagtaccacccctacctgcagcagcccggtctggccaagtaccttgcgagcaagaacattgtcctcgaggcctactctcctctcggtaacaacacttacgggttcccccgagctattgatgacgagcgagtgatcgatctggccaagaagaagggcaaggatgctgctgccctcattgtcaactggatcagatccaagaaccatgttgttctgcctaagtccgtcaccccttctcgaatcaagtccaacttcgaggtcttcgatctgtctcccgaggagattaagttcctggacagccttgacgaggagtctcgacgaaacgaccccatcgagtggggtgtcgacattttcggcaccgccacccccgaggagatcaagaagcgagtggacgaggctgccaagaagtaccttgctgagcagaagaagtaagtacccagcggtatcagttgagacatctttttatatttgacgatgaatgaattttacgattgtattaaccaaggtccaaattgtagacaacggcagtctgccctagattgacaattagatgatacattgaactaacagtaagacgaattagaaccgcaacttggcgcttctcacatgtagataacaggggtgctcgcatatgctgtaattacgatagtattgcatgtattggtgcgatacgactactgcacttgtacttgtgtgtcaacctacagtacagtatctatttgagcagataaaagtgccccaattcagtcctatgattactcagccaatagcaaagctcgtacatgactaagctgatcacaaatcatacctgaagtgggctatgtatcattagcgaatgcaaccttgctttttggcgatctgtagagtcaacttgccaggttgtattgagagagatggccggatgaagggaaaaacataaccagagaaagtacagcggaaataaaaattaaaaaaaaagcgaatgcacaacgtcggggcatcatcgagataattttttggccgtcgtctgcaaaacaagctaactcgccaactggcttacggcgtgaacggggggtgggggaggcactcaagattcaaggccctcctcccaccatgcgtgtataagtttagtgcgtttagttgaatgtaatcggcatggcagaagccaagattgctcagagggaggaaaggaagaaggagctgtgaagcggcaattgggtgtagctgggtccggaaagagctttagaagagcaaatcccgcgcctggcgttatattcgcaagccccgcttaccaacttgtcctcctcgccaattgcttttttcccacattatagctaaaaataccctcgtccaaaagttcacattcctcagtggccaatagcatagaaagctgccaataagcttcgtcttttagtcccaacacaacccttaggttcaccggaaattaaaagcgttaccagtgtcataataacaacggtatttggagttggtgtctggtgggagagagagagaggggctgtgagcaactccaaggcagtagagtgtggctacaccagagaaaagggggcaataggaagggggaggagggaactgtggggttctaaatatatataaaaaaaggcgagaaaaacaaaaacaaaaaaaaaaaaaacacaactcaacaaatccacttacgcccttgtatcttcttgctcatctccactgcaacacaatcatcccacctgcctgagctgacacccaactacagtaaggccgccgccgtctttgacgcgcgtgcagctcacataccccatgcgacagaagccaggtgtagagggggctggctggcggttggcgatggcgcggaggtggtggagaggaatatgtaaaggacggaaagtggttgaaaaaaggagagtggctgctcgtgagcttcgaatggacgccccttgtaacccctcccgcctccttgcatctcatagagcgcgcagtatttctccgtttttatacctcaaaaaagcaaaatccatattaaaataattggaaatgcgtaggcaaaaaaaaactggaatttcgccagtgttcctccacaacgacacgacacacaacatgtctgaagagcacaccatctcgcaagaggtagcttccccaattgtgaagcgaggaagaggacgtccacccaaggttcccacgggcaccgaggtggtcgataccacccccaaggtcaagagaggacgaggacgaccaccaaaggtgcgacccgagggagaggagcccgtggtcaagagaccccgtggccggccgcgaaagagcatcgaccccaactcgggcgatcccagcacacacggaaacgcggttaacgcgtctggagaccccagcgttatagttgagaagcgaggacgtggccgaccgcgtaaaaaccccatcgtcgtggcccccgcacccttgtggcccaccccggacctggtgcagtttggaggagctgacccctacgaggaaattgacagcttcagcgctgaacgcattgaggagcaggctggacaggaaggtgccaacctgacccaccccgagaagctggcgctcatcaagcgacgtctgcacgccgaggcccaggacaaggacctcttggaggcgctggccaccaaccgcgaggacttcttcaacgccgacgaggccaaggacgtgtactcgcagtactcggtgcttagacaccatattgctctgctgctgcagaactatggtgacacggacgagggccgagtgatcaagagaaacctcagcaacctcatgggagtgctgcggtacctgcgattgaaggacaacatcctttctgagctgctcaccattgtgcctctgatccaagaccaagactacaccggtgccaagaaccgaattcaggcgctggacggcccctggtgcatcggaaccccttccaaccgggagatccggttgcgggagacccaaaagtggattactggtttggtccagctgctggagtggtccgatggctcctacaacggcctgtaccgtgtttagaagagaggaggattttgctgtataggacttgtattgtaactgtatgtaataagagatgtattatttgtgttcaacgtgtacaagagcgagtacgagtatcgtacaagtactggtactgtactggtagtatgctttcattttacttgtacaagtacttcaattctgacttctacaccatcttctgagagaacatatctaataccgttgctatcccatagttggcaattctgtatatatttcagtcgctacctgaaacggatagccacccactatacctgtatttctcagcacctttactcgcaaagtgacactgtttcaggctgctttccattgttgttaaggctgccagccagtggaacgaaaacctcaacagagagctctcaaggcgcaatctgggcgcaatctgggcgcaatatagactcggtctggggcttaattatatatgccattggaggtaccattagttacttgtggctctgactgaagtacgagcactcatgctgtactttttgatggaaccagtcctctggtactcgttcttgttctcatacttgaatgttgctgtgatgagatgcgccacaggtgcacgtggtacgagtacaggaaattagaccggagtaattctctgtattccgtacatactgtacatactgtacatgctgtagatatggtggtgtttcgcctttttcttaaccacctcgactcgtagacgaaacctacatcctcaaatcctggtcgaaaatgggactaacctcattccatgctcggtatgttctcgtagctgacttattacgagctccgatcacacaaacgcgagagtacaatcagactcttctcttctcttcatgcactccagtcttcccatactaaaattggccccttgcttgtatcatacaattacagtatcgtacttctatatatgatgataaaaggggaaatataaagccatggggcacgcacacagctatacatgtgtgcttgtttaccatagctagcgggaccgcgtgttattggtgctgtttgcttgttcagtctgatggtgcaatttttttttactgcctgccgctaagtcgctctaaaaaagaaacgcacatttcgtgcctcttccaatcgggcaaagtcaaatgacatagattatgacaaaaccacatcacgtgcgtagatcacccttttaggcaatctccccttacctacaactaaacttggtggaaatgccgctgcagtgaactgagaaagagtaaacacggaggcaaaaaaaaggtgagtatggagcactgggcgcacgggtggagctggcgcgctagggcctgtggacgtcgtgtttgtcgtcgcggagccccagcatattctctgggttattccggtctccggttttccggcgtttctctctctgctgcgccgtcactggaccctctggtcatcttcagaggtcggagatggcgaggggaccttggggctgcgggagtggatgtgtggagggacggtcgacaggtatttatacagacaagcgctgtattgtgaagtttggggttgagatgagctgtgccaaacgactcatcaactggttgttttgttgtttacgtcggcttttgggggcctgcttgcggccgatttggccactaaacccatgtcgttggacaacaaaactgaatcacaggaccattttgtcctcccatagctttctgctcttcctcctcttctctcgaacacctctgtcatctcatattccctgcccacagtccaccctacagtacagcagctgagtacaccttattctgcaaacgtgcaccttaactaagctaacgcacagatgccttccagtcctaagaagaaacgcttcttcaacatcgggtctgttttcaaccccaaatccaacacaaacacaaacgcggcatcgaccagcagcaacaactccaaccccagcgccactaacaactcttccagtggcacacgcacccccacaacagctacctcggatccgttggagttgactgcttctccttcgccctccaacgaccttttgtccggccccaaaactacaaccacaaccagcgacacccccgtgctggccgactttgggaaacaaaaggccggtttccgcaacacgtacatcaacacaagctccacggcgtccaacaacccgttcgcaaacctgggagagcagccacaagccgccacaggtaccacatcgtcgtctagtaacacaaacggaaacgcgtctccagcccttggtgaaagcaaccccgtgcccgtcgcagcgggaaacaacaacaacaacaaccctgttggtctgcgtctagacattacccccggcgccgtcgaacaggtcaagtcgccctcgaccccctacaacaaccaaggtctggccgtggaggagttcttccacgattgcgccggcccctccaacgatatcgtcacatccgtgaccagtaccaacgaccaccagcacgacagcgccgactcctcaggcgactccaacgacacggacaacattcccaactccacgccccccgaatctcccaccggatccaactccccaggaaacatgagcatcgcaggcgcacccaaacgggtcggcgcgggcatgcgctccacttccgcagccacgctgcattcgcatgacaacggtggccagcgagaagtggaccaactggaaggcatggacgaagaagacgatgtccacatggctgactacgacgaagagcacagcggtcagcatggcgactccatggacgacactcccgaactctcttctgccgccggacactccacaaccggagcagcaacagcagcagcatccacagcaggcgccgccacggctgccaatacaggctccactgcgccatcgtcttcacagtccgacgcaccgggctctgccgcctccgctgcctccgacggcccctctgctacatgtgccactgcatcctccgctgcgcctccgtctgcgccttccgagccccaaatcccgtccatccgactcacacccgtcatcgaccattctacttccacccctgcacaatactttggtcccatcgagcgacgtctgactagtggatccattcgcatcggccgtcagacggagtccaaggatgagccccagcttccccagtacgagcggcccattgtgttcaagtccaaggttgtttcgcgatcgcatgcggagttctttgtcaaggacgaccagtggtttgtgcaggatatgcggtcttcctcaggtacattcctcaaccgtagacgtctgtcggaggccggcaagccctccaagccccacgttctcaagaacggagacatgcttcagtttggcatggacttccgaggaggaacggaggaaatcttcaagtgcatcaaggtccgagtggagacgaaccagagctggaaacgaaaggtccagcagtacaacatcgaagcggtggagcgacttcgaggcatggctaacggcgatcccactgactccgagtgtgctatctgtcttgtggcggtgggaccgtgccagccactgttcattgctccctgttcgcatgcctggcactacaagtgcatccgaccgctcatggtcaagacgtatcctcattttcagtgccccaactgcagaaacatttgcgatttggaggccgatgccgatgagtccatggtaatggagggataaaaacatccttttggtattacttactgtacgaatttttgaaaggatatcgtggccatggtatatgactctactagccaatgactctagcatagcaatgactctgttgcagcatcccactagctaatattaatgaagtgtatgaagtgtaaccgtgccggtacttttgtgtacttggtatttgcaccttggaggtgagactacagtaactcgtaccctgcagtacatatttctagtttatttcttgtaatagtcattagctatagatatacaggggtggttaaatgattgacgtgacgattatagcgatcaaatgtagtaatcgacgaagtcacggaggatatcctggagctccttcttggtcttgccctccttccacagatcgtggccaccctcgaggatcttccagccaacgttttccttggtcagacgagtgagttctcgctgcttggcgctccacttcttagactttttgatcatctgggaagaggagacgatctcgacagggatgtccaggttgacgagcacggcgttggaggctcgcacttcggatcgagtaacccaggcaacagcgttctccttgagctggtagccaaggtacttggtagtgtagaccatgtcggggcccacaagtcggtcccaagagccatggccctttagaagagaccagagagactggaggccgagaggagagatggctccttcaataaagagcttgatacctctccacagggtgagagtatctgaaattaggtcttcgtggagggtatcaataaggatcattcccttgacgatggaaatgtgcttggaggcaaacacacgagagtagagacctccgattccgtgggcgacgatgagcaggttaggaagctcggtctggccaccttcttcctctgaagagaagaaagaggtgagagcctcgctgaggaggtcagaaatgtcccctgcggaagtgagacctcggctggcgtcggagaaggcaactccgggtctatcccaagtgcaaactcgggggatctcgttcatggcgtagaggtcagtgatccaactccagtagacctcggaggaagtggatcctgcctcagcgaagatggtaacgttctttttggacggatcgggtcgatcgggtcgtctggaagcaacgtgaggatgggtatcctggagctggagcaggtggttaccgggcaggtcatagcaattgatatggaccttgaaggcggcatggtcaacatcgactcgctttccaggcacaggcacacgggcagcatcaatggcaaacagagtaatggagagagttacggcgatgagcagaagcaggttgacaaggttgaaaagcagattgacagataccttgagccactctccgagggttcttcgagtctccacacggccggtgagacgtcgttcctcggtgctcttgccccactgcacgatcaggtctgagacggctgacagagagcaggtcagaatggcccagacggggatgatgaggccagcaatgacttctccatatcgcagttgcggggtggcaaccagaatgattagatcgataaacagcaagaagatggtggcgtattggatctgtctctccatgaccgagggggtggagaagaaaagcgccgagttgacagtggtggtcactgcaatgagcgaaaagaaccacgacaggaaacctcctcctctggtgtacagactgggtacgtgtacaaacagattgagggtcagcagaaggaatgcaatcaccgagatagcgaagaagacggtgatgaacgaccgggcaatacgcacactcagcaagttgtatggggtcacctgggggtcttctggtgtcagcaattgggttctctcattgggggtcattctctcttcctctggcgaggggttggtgggctccgggggtacttcgttgagagccatggctggttttttggagatgttgaaagcagcgtggtaagcccaattatttattgataatgtagcttgactgcataaaggtgtatgcaaggctcttgcacgcaagacattgctgcctgaggctaatggactgatagtaagtggctgagaggtagctggaaggagatgttagcagtaactgttgatgaagctgtttccaatggctttctggctaaatttgacttatctttgtgcttagaagtccattttttgaacattttgaagcccctccccaaatttcaacattgctatgtcatgtcctttagccttcgcatatagtcttagatcaaacccaaacctctctaaccagcaactcaactactgccagtctccagcatgagtacacattggctttggagagatgttggtgtatattatccatcagctgtttgtggtgagttcaaatacagctggtaaatagctaccagcaccgacatcatcaagtgtaattaattttgcttttgcgcatgtacaatcgcacaatatgcaccactcgtactcgttctgtcggctgtgtctgtggctttctcgcaacatgccggggagatgaggacaaacagatctttaattgatgtgtcagatacgtattagtaagagtccaagtgcaagtgtactgtattgtattccttccatgaatgcgaaacactctcttgtattgcactcttactccaccacgttaatgcatatgctcatcgctactatgtcagttttagcgtgatggtgcgtaccagatataggggtacttccagtcatctccaggaacatacggacctttgcgacacggccagtttgcgagatataagatatggccttcatttcaacagtcagcccgtttcactctcctctgccgataaccagtccgtggtatcatagcaaaataactatgaaaggaaacggtctagatgcggactcgcgtatcgtgaagaggcctaaccgtgcacgtgcggttcgggtggcaattagaatgatctggttgggaaggggtagtgggttttaatgggttcgaacaggcaatagtcatcttcctggtccacatctggtgtttgctacagtacatacagtactttctgagagggtaggtgtttgtatttaattgggagtatcaagtaatggtagagggttagttgacagtttgttgaaacaactcaaaacggaatgacgagagatactgcctgatactctgtgtcagaacgaccggtattctcaatcctcaattgctaaattcgccaccttattgtactctattgtactccaattacttgtgccgttatcactaaccacagcccttcgagtgtgcgagtaatcgccatattgctatgctatagctagtgtattcgaacaaccgtacaagtacagcttctcgtagaccttcccgatgaactgtggcttgacagcactacacactccacttgacgtcatcacgtgacgggagtgcactcctgtgattgtacaggaaagctgtttttcggcgcagtaacaatcaccgaaatccgcccggaatctggggtgtacgcttgttccccacatttcggctcgcagataacgcggtcggccgaaaccccacacacatgtgaacgacttttgacttttgaacgtgcatgcatgcatcaccgttggctaaaaccaatcaatatattggatcgtgttttcccagccttgatctctgcacacacgcttttttgccaccatggagaaactcgttcacattcccgccgtcacaaaactcacgccgctagtgagccggttcctcggcatgaacccgggcaaattttctctacagggtacaaacacctatctcatcggccagggaccccgacgattgctgattgataccggagagggagccgatgagtacacagagacggtctccaactatctcaaagagaacaacattgagcttgacaccataattctgtctcactggcacgcagaccacaccaagggtacggtgccgctgctcaagaaactcaaggataagaaggtccaaacctctccccctaaagtggtcaagtacccgtttcctgagatggacaaagagaagaacatcaacgagggctggtccgtggacgagtatctggacgacggtcaggtgatctcgaacctaggcttccatatgagttgtcatctgtttcccggacatgccatggaccacctgtgtttctggttagaggaggatgatgttctgttctctgcagacaacattctgggccagggaacgtctgtgtttgaggatctgacggcctatatgaagtctctggagggtatgcgtcaaactggcaagaccaagaccaagcgagcggacggccagttccagatattccccggccacggacccgtgatcgataacggctgggagaaaatcacagagtacatttcgcaacggaaaaagcgagaaacccaggtgtacactattctgcatgagaagggtccctctgatgcccggaccatcacacggcagatctacgagggctaccctgaacgtattcttgatgccgctcagcacactaccaccatgcagctgatgaagctggaggatgatggagttgtcatctccgacgcacgaactggaatgtggcagctcaaggagaaggcttccatttgagttgtgacgaccattccccccgcaaatactatagatattagaactgttttcttatgtctcattcgtagatccgatttttgaatgttcccgttcgtagatcgtcagcgagctacagtatctgagacttgatgcttcagaccttgcatcgcagcttttacacatgtagttcccacaggctacagatactcatactcttcttgttcctcccataccgtctatgcttccagcgagagcagagagtatgtgagacgagagggagggtggactccttgatatgacacaactctacaacgcctgtacacttaccaaccctcaaatctctagagatcgcatagcctcggatgtctcactatgagacccaaatggcaaactacaaatacgggatgtgccttcttcggcgcgtgcgtacttccatgccaatcactttgtctcacctatgattctcgcgattctcgtgattatcaaacaataattgaaacagtcgggatcaattcgccagtacctccgctgtgtattgctccaactactggcatcttagtatctatcattagctgctagcgcaggccattagactcacgttcatgacacaatctacagcgatatacacgtccagaccactcaacaaaaggagactctagtaaggctataaagtgaacgtgcccagagagcgcagttcaagtagtgttcccgtacgtccccgcaaatgtaaatacacccctgcctacgtcgtgtaggccctatcttgacttggcttagatcgtctctaccaagattgagaaattaacacttctgagacatggtcagattggcccggttgattgtgggaactgccattggtattggtccttctcggtgtaggttgtgtggcctttacaggtatctaagccgatctaaacgagggatgtttcaattagccaatgttccctccacaaccccttcaatcgcagcatcgcaagtccatgctggctctgtactgtcgtcagttcctttaccatcatcaaataaaacctatatatcacttaaatctctgtcgtaggttggtggcgcttgttttcgatcgaaactgtcgggaaaatgatgcgaaggcccgccgagtttgcacgatcgtgtgttagggccgccagagatgtcgcagaaacagcccttttatttgtttcgcttgaataacagaatgtggggctcgggtgcgtgtgtttcgtaatgctcccatcccagactctgggtgatgcccagacctcgccattcctcctccagcaggattctcagcgtgcccgtttcggaattgaagtagtctctggggattgccttgagcatgttcttgggcagcataacgtgtcggtattcaaatgtgtcgtcactgtatcgtgtagagtagtgaattgcctcctggaactcctccagtcgcgctcgttctgaggacgacagcagtctcggttgccgtgacattgtcaatgtggcggtcgcgtgtttccgaagggccgtttgtgcaactagggctgctgtgtttgtctcttgttaccacgctgttgtcagtgccgtggcttgtccaataataaaacccagtcaggaaggggctgctggtgatctggcgggtattggcggtcgactagtgctccctagggtgatgctgtgatgggaacggttatacttggagaacggttccaagagttccaagtatagcggaatatgttctgatcacaagcacgccaaaaatcaaacaaagggttggtgggtttttatcagggtaagggtactctgccgattcgggccgttgagagggaatgcgccagcacattctgattaggttgaggtctttggtgggtgcactttagcgagcatggtgttttgtggttgcggagctacaagtggcctgggggaagacaagtcgggactggttataggccgacctatatatattttctccacgcccagtcttcttttgtgtgagtttggactgtaggattttgggactggttaaactgtactacaatgtacgagtaccagtattggcatatgatggccatttaatgagtgtagtgacgatttgcaatatacaagtacttgtacaagtgtaaatactcgcgtaatcggcaggttccgtccccagtgccatggggcgcctttcaccacggtataaagtacaacggtacttcctatgtcgttctgttccgagtatcatcactccatctaaaatgctgcaccacgcccaagacagtgctgaaacctcaccgaaaatgcaacgtagccaacctggcgcagagcccacgaagtctggtgcatacaagtgattgttgaatgtgcctgtgtgccggtcagtgcatgtctacgatggtacgatacacacgagtatcacttgttgtagaccattgtctgaattctcacgtggtacggactacagtatcgtatacactcatactcgtactgaatgtactataaactgcaacattggagagagtcacttgacgaggtcattgtcgacagtcgaaagtacaacgctacagcaagctgctcaaacacacatccgacacccctacatcacgtcctctgtacacccaagaactttcgcatcgcttcgtgtcccttatccaagacttcaagtcacgataatttataaggaatcgcatcaccccacaatcaaccttatcgagagccccttgttgaagctgtatctacccgtaaaaacgggttatacgagcaaaggtcagcatccgacgtgcaagtatataaagacacccattccaaccctccaccatctttcattagtccattcctgccacagcccctttgccaagcctgacggacagggagggcgactgtatggtacgtggacgatggagagaggcatggtgcattcggagttgtcgatcccaaacggtgtcttagaatgggccgtgagtgattatcatgacttgtgcgagttcgatatgagtacagtatgtacccgtatgtcaccaaacctgccccatcatcgtcatagacatgccgaaaaagtacacctcgtacaccctgcaagtaacaatggactaacggtaggctaagtagacactgactaattctcagcgcaactatagaacaagtacatacaagtagctacagtaagcagttatagacaagctaagcaagtacagccgcttggatatatgtgggccacgagagttataggcgccatttagccaaacggtgacccagtcttctactgctgtaattcgtccaaaaattctacaagtaccggcatcgtggtcactgcccatgctcatcgcccatccctgcattctcctctcccgtggctcagttcgaaggcgaaattaccctacccaaacgcggaaccctatttttgccagtgtccgaaaatagcctgtcaaggcaacaagttcatccgcgtgagtgagcaccaagaatggtgtctgactgagtcttacaagtggtagaaatgtcgtatgacagacagtcacaggaaacacaggggaaagatggccgctggttcgctcagtcacgtgactccctatacatttcaccacagtattcgtactcgcacttgttttaggtgcatagcccatctcctccatgagttgaacgcgttagtctggcatcatttgtaggttaagcgcaacattatagcccagctactggagttaattatcgggatgggtgtttgtagggggctaggagagggtgacagcgtcgaccaaaacggctcataatggcgactcaagagtattgggaacattttcaaagccccaaagcccctttaaataagcccccatttcttgcccctcctctacacgcataggaacagcgtttacatatcattttcaccacacgccaagtaaaaagtttatacacaagcgatactacgttcctgccgtcagatatcagcccagccaacgtctccctctccctctactttccacacatacacacattcaaaatgcggtttggtctgatacccgcaattttgagcgctctggcgttcctgctgggcaccgcccgagcagatctctcctttatggatctcagtaaaccagacacggtccatgaagcactcgctttggtggctggaggcctcatggactactacgatggaactcgacccggaggaaccgtgggcatgtttgtcgctccttactactggtggcacgccggcgcagcatggaacgccttcatcgactactggcacattactggaaacgacacctacaacaacctcacctgggcagccatgaagcaccagcgaggcgagaaatacgacctcatggtctccaacttttcttcctccgaaggtaacgatgaccagggagtgtgggccatgaccatgatgacagctgccgagaagaacttccccgagcctggagatgagtacggatggctgtacgtagcccagggtgccttcaacaccatggctgcccgatgggacacccagagctgctacggaggtctgcactggcagattttccagtggaactctggttatgactacaagaacgccattgccaacggagcactgttcaacctcggagcccgtctctaccgatacaccggaaatgtgacctatctcgagtgggccgagcgaatctgggactggtccacgcagattgagattgtcgacaacggccgagtttacgacggtatccacttgccaaactgttccgaccgatctccctacctgtggacctacaacgccggtatttacctgtctggagcagctgctctctacaacgccacggtgctgcgaaatcacacggaccccaaccacggtaagtggctggaccgagccaacgagctgtggaactccaccaaggggcccaacctcttctttggcggaccgcagaagaacattatggtcgagattgcctgccagcagaagaccatcacctgcaactccgatcagcgaaccttcaagggtatcttctcctcgctgctcggacagaccgcccagatggtgcccactcttgcatccgacatcatgtggtacctggaggcctctgcctacgccgccgcccgaacctgcagtggaggccgagacggacacacatgctcgctcaactggctcaccggccagtactccaacgactacattggactaggagaacagctgagtgccatggaggtgattcagaacacccaggtgctcaagtccagcggacctctcacagatatcactggtggtacctcaaagggtaacggtagtgccggagctttgggattccatccctttggagaggatgaggctcatcctctcaatattggaggaggagaccgagctggtgccgccatcatcaccgtcattgtcggtgtcatgatgattgccgccggctggtggttgcttgtgtaagcgcactacgcttgtagatattgcccatggtgcgattcaagtttgtagagcacatcctatttacgaatttatgttttgattttgaccgcaatgcaaatacagtcagagagtaccggttgccactgtcaaatacaagtacaatagtctctttgtgcggattccactatccgtagccacaagtaccggtagtttataatctttcaagaaacgcgtatccatcaccttatctgtgccacaacactcctgccatacacccctattccacatctacaccacctacaaacacaacatgtcctctcgtcgaattcgccttaccacctcgctcatccagtcggtagcctcgctcacatgggcgttcatccagaaacttggcaaccgttctggagagtttctcagagacaccttcttcctgccgtttgtgttcatcagagacctttcgggcctgcaatttgcgtacctcagcgacctgtaccagctgctggtcaactaccaacgggagatgagagacgccatccctgccgttcccgagcccgctgttaagcttgactagagatgttgtgcattggctgaactactactgtgcgagtgccgcaggagcctctagaggagtggatctcacaacatggatcatgtcaggaagcatcatttcagcccaaaatcacccccaaatccagttaggcacccaattctggattcagccaacttgagtgccagtgaggctaagtcaaggaaactaacccacacgagtatcgtagatagctcaatttaatgtcattgctacaactacaagtagtaacaaaccgtggtcccgttatgaatccaacatggggatactcaaaatatctacagtagctctttactacttgtagatcgctacagaaccctcactctcacctgcgacttgtacccgatgacactggcacttttctataacttcaagtacacagaagacagccatgacagattcaccatccaaacacaactgcatccaagaggccctactcacaatatgaacagataggaggataagcccaatgagtgattgactttcatatacttattcagctttagttctgctgaagaaaaagggtctagggatggtgctagcggagtacaggtgatgagcagcctggctagatgagggactcacacagggtgatgccttggaggggttggatacgagtgactgacagtggtttatgttgttgattgtaactcaacaactgctgaattgtgctgtagctatccaatacttagcgtgtcttattacaagaaaagaaaaacaatacaactgggaataggtgttgtataccacttccaaaagtactgtagctacttgtagctaaaagtaaccatcccttgcaactctcgttaacgatccacatctcgcattgcaagtatgttacctttgtcctagctaacgatccgcgatgcgtttacagtgtggagggtttaggtcatgccgaagcggagataccgtagctcttgtgggggtgacttatacatcacgagtctgtcttgaagtcgggatacgggaaacccaacgtttttctgtgtattttggcggctccatgtgagctgacttgttttgtgtccagtcgcgtgcatctagtgaatcaggcacatggtcacatctcacacatcccttctaattacttgaagagttgcttcctttagttgtgttaatccctccaccttgagcacccgcatcagccaggcataaatactgcgccaagaaatacctcatgcatgttagccggagttaatctcagagttcgagatcagaaggccaccgctaaccaacggttgactcagagttttggaggtgagtttcaaagattcttaatgacactcacagccgctcataagagacgttcatcttctttcccccacaaaacaagcaacgacactcgactttcaccatgactatggtcgaagacatcgtcggtaccaagccgggagcagtgtacaagaccggccacacggtcaagttcctggtcctgtttgctatcaaaaactggttcattatcggcatgggagtggtcattttgctggcgtacctgtttcccaatgttgcacgatcccacggagtgctaagagccgatatcgccttctcatactgtgcagtcgcgattatcttccttatttcgggactatccatgcccacaaaagtcatggccaagcaagccaagcactggcgcgctcacctgatcacccaaggcctatcgtttgtgatcacacccgcggtcatgtttggttttgtcgtggccatccacaagtccggaaacaaaaacatggacccgtgggttctggttggaatgattatcgccggcaccacccccactacagttgcttccaatgtgttgatgacccgaatgtgtaatggaaacgagtccctcgctctgctggaggtcacagtaggaaatcttctcggctcttttatctcgccgggactcattcagctgtacctttccaaacatactggatttgcctacggaaacccggcaaaccacatgagtattcgagaattgtacgccaaggtcatgaaacaggtcggtctcagtttattcgtgcctctgtttgtcggacaggtggttcagaacgtattcccaaagcaaactaagtgggcggtcactcacttatatttggccaaggtgggcaccctgatgctgctgcttctcatctggagtacattttccactgcgttttacgacaaggcctttgaagaagtccattatacgaccatggtgatggtttgtttcttcaacgtgggtatttacctcctgttcactttgctctgcctaggagcagctcggttgccggtcaaccatctgcctaagccgacggagaactctggaaagttctacaagtggttctacagaatggcacgaccgttccatttcagcagaaaagacacctgtgccatcatgttgtgtggagctgccaagactgtcgctctgggggcgcctatgatttcagctcagtatggatcacagtcaccggtgattggaaaggtgtccattcccctgactctctaccagggcgaacagattctggtagcccagtttctggttcctgtgttgaaacggtgggttgctggagaggatgatattcccaagcctgaagacattgaagctcctgcaataaccagtagcagtagtggcgatgacgttggccacgagcataccaaggccgaaagacgacccacccgtgaaccttctgtccagcctgaagcggtcgccgaaaagtaattattaacaatgctgtgtatatggtatacttgatgtaacaaatgatgagccatgaaaagtgatgaaggaagggagtaagcagatagggaacattgagaccacaagaagaaacttgaggagttggtgagtatcacctgacggattacgcacagccactggtgttctctatagccgaatgagctaagcattacaacacgttgagggctgttggcgtccaggacaccaaacgcctacatagctcctgtttcttgactaactggttctttgtcttgacgataaacttgttcttgagcatggatatctacgagactgtgccaggcccaactgtttgccgaacaggcagtggtgtagacaacagtgcgaggcttggagatactgtagagaagacaatacaaatacctgtaggctatgactaagacgaaatggaggcgtggtactagagagagaagcagaacggtcctatcaagtgtcacgacggcacttgctagatgagcgtttgcgatgtggtctaaagacaccgacactggattctagtgtccactacagcttgtactagtgatatcacgtgatgtcaagtagtagttcagtaggacagtcccattgctcacgtcagaaatctactgcaactgggttgactccgtacttcatctgtgacacactgtgcaattcgttcgattaaaacggaacatgcattatcccagggattattccacatatggtataatgtcaactgtgaaagcggccatgcagtgaaaaatatttaacagacaatatttcatctttttgaaatgccaaaaatcttcgaaatggctcttcatttactgtaattcatcccagattttgatcgtcactatagtcggaatctctcgcagtatctcagatgaaattcactgatggatctcgtgagaaatgaataaagaactgcaagtccaacccaggaccacagtatgtacaatagtcgaacaaacaaacgaagagatccacggattcccaggaaaggtaccaaatcggccctgacaaaccaactcatggccaattggcagattcctattctcaaggcaagaatatcctctgaataactcttgtcctacactagaggatgtgagagacatctttgtccgagacgtagccttagtttgttctacagagaaaagccatatgtcctgtcacaggtatccctatacttcttcagtgtctcagcaaatggatctgctttcaggatctgctcttatacagcagcgtttgcaagacatttatgtttataacttgtctattctgaacacatgcccagagataaaatccacctactgtgaaggagatctacaagtagagtaatccttgatactcaaatgcttgtacttgtactgtagcgctgaaaggcgaataaaagttcatgaccacttcgtgagtgactcttctctactctacagtccaaggagatttcccatggtatgcatcgtactcggactctgggcactccaccgaactacagtacaaaccagtgcaagtacagactgagccccgtgactcaccgtcgtgactcgtctgaaaatcgtcagtaataccttcctttaccaaggtatagcaccagtatcggtacgaacagttcagtactattctgaatttcactcgtagttatgcaaaaaaaaaataatgctacgataggtccagaccgattcgcgtgatgcgcttgtaattatctaccgatacgcgatggataagtccagggcactggcctcgctcttattcttctacgatcgaactacactgcgctcgctgttctgggcatgaaataatacatctttttcttttataaacaaccgtttaagcctggacagactgagttcggagagaagaggctcgtcgcttcttctcctcggccttctcagacttcttctcggcaactcgcttggcgagcagctgggcgtactcagcggcagcatccttggaggcctggatggccttgaccttcttctctcggagctgggccttgtgggcgagtcgtcggggagtgatgagtcgctggatcttgggggccttggtgtaggtctttccggacttggtggtcacctcacgtcggataacgtactgtcggacatcatcctccttggagagagcaaacagctttcggatgttgttggctcgcttggggccgagtcgtcggggaacagtctcggtggtcaggccctcaatgtcggcatcgccctgcttgacgataacgacagacagaacagacaggtcggaagagacaatgcatcctcggacggactttcgctttcgctcaccggctcgtcgagatctgtaacaggaagagtccttggacagcagaagtcggactcgggtggggtgcatgactccctgcttcatggggaaaccctgcttgtcgttaccaccggtaatcttgagcacgtagcccttgaactcgtcaccgaggaagtcagcctcaacctcctggcccattcgcttctcgtagaagcctcggactcggtgctcgtcctcaatatcaatgcacttctgggtgccctgagcggggtatgcgatgttaagctggtgttagaaatttgtcagagatatgatccaaatgtgatccaacataattcgacaaacgggacatggtaatttctcccctcaataccgtctctgtcgttctcccgtgtcgccttagtcacaccaatatccaccgtcactcaccttcattttgctattgtcgaacgctgtagagaaacgaagtgaaaatgtcaagattacaggtgggagcagagtcgaaagcgtaaaaaagcgagtcacaaatctagggttcttagggttatgcacgtgaccaagggactcaaaacagaccaaagtcccaaccaaacctaatggagggaactgtgagcacgtgaccagaacgatggggggttgtctggggccggtttccattgtttaaaaaccgactctgaacatttgagatggaatcgagactttaatgcctaatctggaggcgtattgacctctaacatggtctttgtgggttttttttagaagatatcttgaatacgaaaccgatacaccttaactttaataaattttattggtacaagtactcttgaacaaaaggtgaaagtattgtaatccaactggccgtgttcgtagatggtgagaaagggataaagcagggtactgtagttgtggggggtaagtaatagtacgattactcgggttgtaccaaatgacgattttctgtatattccatgaaaatacgtcttcggtcacatctcatctcgagatctcccgtagggacccgctgaatcgactcctgcatctatgtcggtcaggttcagtgcagcagagatgttcaaagacccgagtgtcaactgcaaagtgaggtttagccgtgttgtgaggtgaggtgaataggggctgctgctgttgtatgacagacaatgtacaaggtgagagtgagtgcgtgaggccatgataagacagagaggcatggcttgtatcatgaacagaagtacgagtacaattctacaagtagtacacagatctgttcaagtagattcacacccaagtaccggtactaggattcactccggcagattttgtcgttctcatctgcactcaagcagcatactgcatactgtgctactcagtgttctactttcaagtcatcgtcttgagagacatctacctgtacatactgctgtactgaaacgcgaagacagcgttctcagaatgaaacataggcaccatcagagtatgtggacccgtggctaggattgaaatacccagtccgtgagctgtctacctctacaacacagcactatatgaatatgtttcctcgcagtatcttacacattacagtatggctacaacttggctgcccttctcacttaacacaaccttggacattgacacgaatacctcatttcatcagaagagagaagttgtatacatacaccaacatctaaaacttgaatcattcgtattagaagtacaagtacaagtattctaggagagagaacatcctcagttggtaactcaccaacacgctcacaacgtagacatggcgaccagacgtacacatctgccatcctctaaatgaagtacaatgcacctgaacgccatgtaaggctcaataaaaaaactagaaccactagacactcgttccaacattctcctgcgcccttaccacactgctcatatgtatcgtatgagtacttgtaacctactagtcctggtagggttccgcatcaaggtgcattgataaggcgtacagaagtgctaacagtaagcagctgggtgttccatgcctagtgagtaaaccaagccgtcgaacatgattcacgacagatcatctgcgtactcgtaccatactgctgcctctctgttctacaattccccatcaaaactattagaatgtattgtacaaggagtgttagtacccaaactgggtttattatataccaaaaattgccacattgtgtccgtggaacaagttaatcatcatcataatcaatcatcatcgtcgaatcgcatcgcatcatgtcatgtcatcatctcaccccaacctctgcttcttagggtccaacttactatcgctgttatccacccgcttcttatctttgcaggcactggtgggtatcaaggagcctcccgcagaaaaggaagagccccctgcagacccggggttgaagttccactctgtgccgtagaaatttgacggactgggcaacaggtcgttaatgtaccgcgatggtaacgctgccgacaacggcgtttgttctccattcagaagcgtgggtttcgcaaaggggtttccagggcccactcccgagttattaatgtacgaggagggagagggtggtggtaaaagcagcgcggcgtgtgaggtgttttcgtccttggacccatctatcggtgtgccttccccggatgtggatctggagttccctgcctgtcctgctgtggagccttgacctccaggtccagagttgcctcccgtgctgcctcgtttctcgcccggaatctgaaccttgagttttggcctggttaccgagttctgtcgagacgagacccgtgacgagccctcggatcctggaatgtatccgctccctgccccggccacgccctggcccatagggtttcctccagcggttgcggggatagaactaggtggcatgtcgttagttccacgccgaatgtccaacaggtggcccgccaacgagctcatttcctgcgaaatgggggtgaattggctcttgtgatgctgttgctgttggtggttctgatgctgttgatgctgatgctgctggtgctgctgagcatgttgtgcctgttgctgcaattgatgatggtgctgttgttgctgcatcatctgttgctgtaaaatctgctgctggtggggatgctggcccatctgtcccatgctcatgtagtcatagtaacgctgctgctcggggtggtggggatgaggcatttgctgctgctgagcctgttgaacctgctgggcttgctgagactgctgagcctgctgctggggagtcagctgctgctgaggtgtcacgttttgaggcatctgcggagtcacgctctgggccatccgtggcgtgacgttggggggcatctgaggggtggcgttttgtgttccgttgttagaatcctcctcctcctcttcgtcgtcctcatcggtgggctcgctcttgatgctcgtgacgcttcccgtggctctgtggccgcccgcccgctttttaccattgtagtcctcaggcgtcttcttttcgtagggaatggacttttggtatctttgaatgagctggtttgtgtctgttgacgagaactcatacagcttctggttggcgccaaagacaatcacggcaatatctacctggcaaagcacagacagctcgtgggcctttttgaacagtcccgctcttcgtttgagaaatgttctgagttagttgtgtcctacaagtaggtggcgaggaaagaatagtgcagagaagaaggaggtggtggacaagcacgctcgatggaaataacgctgttacatgtcttaatcaagtgcctgttttctccacttgtgtatctgtttctcctcttgcgtgtcttgatgtcgcgggctatgccagaatactcacactgaacggttgcgttcgtcttccagcggttgaataacaatcttgcgacgtcccatggtgatgtgtttgtgtcgagcagaatcctttaacggtgatggcttgtgttttccgtcgctgtcgtctcgtgtggtttggcacgtaaatatgtcagaaggaagtgctattaatagcaaggcagttgcaaactgaaaaccctgaaccaccctctcccaacgtcaccatgcgtcctccatgcacggctctcacaggatattggaaggttaaaaaattacttcctggcgcgacccagcacgataggctggagtagtggaccgagagagtagctgactcacccagacaagctaatactagtgcagtgaatcgacccatgtctttttctgaaacaaacaaccgcttttgagcgcttttcggtgcctttctcccactcaaacacgtatacactgacagttaaagtcaccccgaaaagtcagcctgggtcacctgtggaagtaaacagcatatgtgctccttcccaccccccaaaaaaaggctcttggcaggattctccctaggaggtattccagagcaccccctggttgctcccatctcccgttagtgacgctagctggggaacatctgtagtgaggcaattagacatagctcaggcggcaaaaacagccacatagggcttgtagcggtgtttttttcgagctcgtatcattatatggcctgaaaactacgtgatctccttcccaggcacacccccacacgcgtcgccgttttgcttctaaagatagtaacatgtacaatcaatgcagacccccgaagcttactataaatagaaccagccctggggtacaccaagtcgaagagcagccaacagagaaataaccaccaggatttaggtgaaagaaagaagtttgtacgcctgccaagaacctgcaagttacgcgaaaaccgtctccaagattcaacgtcatcaataaccgaccctgaactgaagacagaagaccgaagacacatcaaccccaacctacatgtccactattccgccttggtcagacacactacgatcagagctatttgtacccgtacgtgtagatagttacatattttcggcctagatctcagcaatcaatacgactggctcaaaaaaagctcactgccgcattacagaaggacgcgcacaccccctggggtaaaggtgcagacggtcaaccacaagatccgacgcgatgagcatctcacaggttctaaatataaatttaaacacacagaatacgagcaaggcactggaaagacgttactcaaagggcgctgggacgggtgcaggggtctgaacggtaattcgccaagatcatctcatcctgaccatgcaagcttatgtgtttacttttcgtttcaaacacctactatccagtacatccctctgcaagtggaatccagggtcgtagtgtctctgttggttgtcacgtaagagcgactcagccgcctatcttcatcccattgacttgttgacaaggatacttcatcgacatactctactcgtacaagtacttgtagtgaatgtgtatgatcattaatgtgatatattatgacggcaccagtgcctctaggaaatgtgcgaaaggaactcctcaacgtacttttctacctgcggaacaatgctatcgtcctcagcaacggcaactgagatgctaatggggccaccctttattcccacagtggaaaactgaatgaaaggacaagtacctcctgtgcattgagagaaccgcagccgctcaaccgtagtagaggtctccagagcggtcaggttgctcaaagagtacattccatgccgctggtagttgttggtatgagaggcaaagtagtcttccaggtcaacgaaaggaatcagaccaatgatatgcatgaaaggatagccggagaaccatgtcgagactccgtccttcttaatctgatcctggtacaccttggcaacctccaggaacccagaaggaatcgttggtccacttccaaattcaacatctgcaggcttgggaaccgggttgtcaaacagagactccccaacgaccattcccagacgttcggggtcctgaccgggtgtgaatttacgagcattccaaggaatggaaccgctcacctgttgctgaactgcgtcaggatacttgtcatgaagcacctttgacgacgagcacaccagaagaccatacagaccggcccctccactgatggaatgtgccttgcacattttcagaaacgcgcttgtctgctcggtagtcatatcaatgacaccatagtaccccgtccatgggagaacctgaggaggcaaagaggttttgggttttgagaagagatactcgttagccagttccttcaccagtcgggagacaggagcggaaacggtaatctgtttctccacgggtggtggcaactctttctgtgacacttggatcttattgtcatcagatcttttgccttgtcggtattcctcgatggacttgaccaattgacggcatgcaaaagatccagacattccgtccagaagagtgtggtcgtagagaaagaggacttcccggccgtggtctagcccaacaactttccagtgagccttggtgagatcaaaccgcacgtaatggagatcggattgggcttcactcacctgcttatcccaaaatgtcgtagtgtccaggaagtccttgacatcgtagtcgtcggcattcagtttgtgcatttcgtattggcctggcttgtctcctgtaatggtgacacctaggatgggttcattatggatcagttgacacacggcgtattcaactgcctcggttggagcggggtctcttaatcgagcactcacaaaaacgttggagtagctaccgaaacggcttcgtgtagccgcgtacgtttcgtggggccccagcttgcgcgacatggttgtatatgaaagaggaaacatgacatttggcgttaacatttataacccaaactggagtgcgtgtcgcgtgcaagtgaaagcttaacaagttatctaagtatatactgtatattcagcgagtattagttagtctttagtgtagctacaagtcagactagacagtagcaagcgtagaaggcggccgaggccaccgagagaacagcgtagcagagcgcgtagtcaccacaggggacgcagaaccaaaccaatgacgaagaagaaccacgaggagacgttttcaaaggcaatgcaaacgaagagggcaatggaaggattgagattagagaactggagactggagtggcgttttcccgatgaacgaacaaacacgcgaagctatgtggaccaacatacaacacggactgaaccaggtttttttatgatttttttactggaaataggtacgtgccaagttggaccatgacactaaacgtgtttaattagtaatattcgtgtaagcgtacattaatttcaaaggttattctttcacagcaaagttataattaaatgaatgtagctacagtatatgcaaaaaaaaaaaactagctacttgtaccaggcaccggtacttctaccacattaacaggttgtacagaaccgggtttctagatttgatacgataagagagttaattaagtataaagtggcacagccgaagaagagaattgaagtcatcctgtttaagcagaggaaacagggtgggcagacagaaggctcttgagggaaccggtctcgagacccagagaagaggagagatcctcaataccggggagctttccaagcatctgcagaagtagagagacattcttgagaagtccatcaatggactggacaagggggacaacaaggtagtcaaccagaccaccaaccagcagagtgacgagcttctcgacaacaaggagaagaccgttgatgacggggttggctgcaatcttggcaacgaggttaacaacggagccaacaagaggaatctttccaagatcggccagaagcttgtcgactccagtgttaagagtggcaaaggtggaggtcagaacagagatctcagtaggccggtctccaggaggcttgatgagggtgttgacagtgccgtcgacaagagagagaacggtctcaacatctgcatcaacatcctcaatggcgttccagagctgtcgagcagccagctcgttagaagcaggggcaggagcaggggcaggagcagccagagccatggcggcaaaggcagtggcggcgatgtacttggcagagaccattgtagtagagtgtaagagggaagtagaagagtgtggaaaggtggttgtggggaaactgtgaagttgttgtttgatatcgatttgagaggctccggagggtgtttatatgtgttttggacgagatcaaaaggtggagggtatctggtatctggtatctagaatcaattaactccccagggtggatgcatgggttccgtcgccttctcctatctccagaggagcgttatctcgtgcattcggtgggtatattgaaaggttagacacgaaaagatgactgttgagctgtggagacttcgacatcgagctagtggtgcaggcactagtgcgagttaaaaactcatctccactgataatttcggtgaggtttgcagtccttcattcatcaggagttcatgaccatctcaattcacttacacatgtcatggcattatcatcactcgctaaaactcttggctgccgcggagacgcatatcccacgagtcgccgatggtgtggagaagagttaaaaaaccttgttcgttacttttccctcctctttttgagacaggtggtgaaaaagaaaagtcctcattggccaagtccgacttatcaggtcgacgaggtggacatggtggaccttgtactgaaatgatttgcatctcgcaattcatctgcatgtgggacagtgggcttgggttaggacttacgaaaatgggagagatgatcctcctcttcttctgctgtaccgggtacaagtacgagtaccgatagtacactgtaagttacgtattgagtgttttctttttcttcggaaagcggccgaaggaggctatgttccctgctcgtatcagtacgtaccctattctattgtacttcggagatggaccttgcgtgtgcaaaaggttgggtctttgataaggacattttcgggtcagacattctccttgaacgtcctcgacacattctgtcttcttgctttctatccccgagggaggagttttcattcatgcggtcccattcagaccttgtatctatagctactggccaacataataaatcttcgactaaccaactatcgttggagctgttggcgacccatggaacaaacttttgttcgcgataaacccatcgttttgggtagacggtattggtgggcatgtgtatacgttgagtctactcttgcatctcaaaggtggagtgcgtcgatgcgtccgctggtgcatcatcagtttgaaggtgtctctaaaaaactcgtcctgtccagctcctagagccgatttatcgacatgtaaatccactatcgttggtgccatctgaagcatctcatttcttaacaatcaccttatgtactagtgcgaaactgacattattgttgccttgtttacacaatataaagaatataaagactcagctaagagtcacacgacaacagaccccttctctaacaactccaagctctatacagtagctacttgcaacgttcagccatatcgaaaagcggacaaatatgagaaaatctttttcgtcccgccgtttatatttgctctgaaagtcgctcgtgggctatctcgcttgacggtccctgtatcggcatccccaccactcttgcagaaactgtcgatctttgctccccgtcaggatcaacatggatacggggagagaaaaagcagccatacggtgtacacgaagccgtatctgagctgcagaacaaaaaccggattacgaaaagttgcttgtagtctttctttgctggagaagctcaagacgaaatgatttaccgagtcttggccctgataaaggtctagtcatagataacacaatggtagctcctatcactccccggcatgatctgttaagcattgttggtcacacatcttgtctaccacacaggtgttactctgtaagtcgtcaattaatcaatttccatgctctatctatctataatatttacattgtccccgtagtttgtccctcattgtctttcgtagagttgccctcttatgtctgtttccctctccttccttcatgctttgttttgcagtccacattttgtttctactgcaacttttgtcgtccgtggtcctccaggttgaagggatcgtacacatcgaacgccttcagagcagtctggtacagcagcaacatgatactgctctgtgtggaagtccagacgaatcgaggccacacaccagagaatagcccagcaaaccgctcagtacgccatatcgttgccagtgaccgcagaactgaatccgacaaaatcacccgagtgtctgtaggtcctccaaccgaagttggcttggtgatttgtgtttgaagacgggtcttaacgacatccagaggagtggtgatgatacctgcgagacctccaccagctgcacctgtcaacagctccaggccgacgcccatgtccttgccatggcccacataatcctgagcccattgatggaacttttcgtagaaagcaaactgcagtcccgaaaagggcaagtctcgagccagagtggctttgtaaccgaagaagagcgctcccaggccctcctttctataaatcgttttgagcgcgtcgttgaagcctctgtagttgtatcccgagtagaagtgggggttgttgtgtcgcccttgaagctgcagacgggtcttgagcacctcggatggcacgtaccacacagacgacaccaggtcacccagaagtccaccgagcaaatgcacaaaggtgtcaggagccttgtagtaggcgccaattcgttttgtggtctcataggtaccgaaaaacatgcaagttgccgggaacgaacctagcagtgccggcgtgaagccagcgtatagtcctcgaaagaatccctcctccagatagagcgtcgagtatgctctcagcatgctgcggtacttgagcgcgtggggagctccctgctgtcgggtcttgacggtgtcgagagaatgcatgaccgagtctccagtggcacctccgattcctccggaaagcaccacgtatgctaggggcgaatgggacgacagcgagtctgtgtcatcggctgtcatgattggcgcggaagaaagagtttctggggttccccaatcggttctatggcacctaggtcgtaaagcacgtccggtcgatggtgggtctggtcgaaatctcgaggatagctcagaaaaaaacatagtttgaaaattatatgcatgatctggtgccgcagcgctttggcgtgggttcgactcctggttggggtggtgttgttggaggttgctgggtaagtttgagatgttcaaagggaagttatagcgaattttctgtccgttaatgagtaattttccaatttatgtttttgttttatgcgagtatgaccgcacaatgtgcccctttgcttacttccgttctggctcctgtgctgattactaaccctcgaccttccactggctgccccccgtcttttggaagcaagggagttgtgagcaaagacgctaatcagtgcacatctctcttttgattgaacgaatctaagactgcttcaataggttgcttcaactacacctcaacgatgggatgcgttgctgcaaggatgacacaggccagcaccatgatggaagaacggtagttccataaaatgacctttggttgatgagaacagctgaagggaccgagaggttctgccgtgtatgttcttgtatatatattagtgactaacctgcattataaaaccggtacgagtacatgttgccaacagcatgacaaagtgcgtatcgatggctgttcttgtcttgtagctacagtatgtattatcagatggtacgacatgagataaatatgcaatgagaaacggagagactgtgggcgacttctttccacacatctatcatcttattggtacagctttacagtagcatctgtctcctcgggccttcccattctccagcttctgtctcgttaataccactcaagacagctcatgacgagaagataccatgattaagacccttcaaatacacaagacagccaaagcagaggacaagagaggactgaaagttctctcgcttcgtcaacagtagtctggattgtgggtgggagcctttacgtgagtcaggcactggaattataaccacaattgtattacgaacgtttcatatgaccagagagactttggccgttgaaccaccgcggaaaatttattcagctcatcccaggccttcttcttggccgcattcgagatgttcctgttggtcaacagagttctttctgtagtcagtatatccaataccggtgcgagttttgaaaacacgattctcaatatacatccggtgacaccaatcacttgactccatgctatcatctgcataaaaccaaagttggcacatattcttgtatcaaaaaaaaccgataatagcgaaaacatgtatagtgcttgtttgtatcgttatagggccggacgtatagtgatacgcaggaaacgcagtggggacgtctgttgagttggaaaccgtaatgtagcgaccgggacgggccgctctctatgtctctatgtgcctgctctctgcaacgggtctgtctatggtttcgcagtttggcccaaagcggtacacttaggcggtgttgctttgtatgacgagaagtttagagcggaaggaggttcactgaacattgtagcgaccaaattatcataccgcaaactgcagtcttcaaaccgagtactgtatgtacggcggcaccatacttgtatcaggtgcagcagatatcaaatctgtgcacatgatgtgtttgtttgttgtactcggtcgagtccttgtatcgccttgtctaaccacgccgctatctgacggtttagtcgctcgcttgtcgtactcgctctcaacctagaattgttgacaactctgaccctgacgacagcgtatcaggaaggctttggacgttgacatattgtccagaaaacacagggtttcgagtgcttaggtttgcgcttttttctccgctgggtttcacatgctgacgtcccagcgcaatttccgctgtccaccaagggacttgtctctccgctttttgcaacgagcttctgtccaggtaaattggtaaacaatgcaaatcaacttgaaattttaaatacgggactaatggagctcttcccggcactagcgaaggtagggaagtgcagtagctcaggtgtatctcttttatggctctttcgccgctttgccggtggaactcagaggtcctttagagctccaaactgaccctactctcccatacattggtctttggctttggccaaagcgtgcatgtggtctctctgggcgagagtttggatgctctaaaggctctccgtttttgtgaacttagacatgcatccgacaccgaggatgttgaaacgctgaaacaggtctggggtaggggtgtgagcggaagcctgtctgtctgtctgtctgtgcgagttgaccaacttggcacagcgtatttggagcctgattctgtggactggtccccccacggttgatgcacgacgagtgtcattcagtacgtctaacatatggtctgctacaagtagctaccggtacgtgtactggtactcgtacagtacacctcggaattgtacttgtggacaaacagagctttggtttcttttttctcgtctccgttcacaaggatcacaggtaataaagacaagaatacccggattctttgcatctcacaatgctaagggcctgctctaagttggcattagacgtctcgggggctttagcgcagacattagttcaatttcttcagccatatcgcgctagtaggaaccttgagaccagctcatgagatgccacgtagcacaaatgtcattcttttgacgtttctctgtctctgcagattttcatttccgctcaatggcacttgcactgaccacccctagctgccggacgctcgttgattatgtcctggggttgagacaagaagaggagagagagttctggacagagtcttgtgccaaactgtgctttttcaatagacggactttcggtaacattacttgttccgggacagcttttgacagctccgactaatgttctatggctcatgatagacccatgctctttggtccatgacaaacaagactcattagtccaggaacacaagctggagcagcgagcgcgctttggataccagagacacatggcgatccccttgtaccagacccccacatcacccccagccaacaaatgaggagagcgattgaattttgtttgtcgggccctgcgtgctgacaaaagcaacccctaccccacgcatgtgtttctcgtcttgcgtgagtgacaattgacagctgacagctgctcgctctacagctacttgtagaattagtggcttttgtgcgacctatgactgtttgtcttgtccttgtgtttacaaagggtactagttgtgcttaacaatgtgcaaactgcatgatggtgataagctggaacggcaccaacggttgcaacctgcttgtctgtttggttttcggccacagcgatagacaattgttgggtctggatgaacatcacagactggaaacctattcgctctcagcctcgtagtttagtgaacttttaacggcactccgtttcactcctcacaagggtgtaggacaggcagagagggtgttagtgacattgtcgtgcagttgacaaatattggctctctcaattggggtaatggtaatgctgctcaacacagccaaggcggacgatcatacctggagttggttttcaggaaatctgaaactggccctggaggcaggcctgtactgtgtcgctattacccggccaacgagcccgtattcgtttactacctgactttactttttctggacactgtatggctgatgtggaagctggcagatccacatatgtaagccgagagttagattggcacaagctgtgaaaccctacaggaaggtgcatttttggagccgcttttgctgttaaacctttggacacgacgaagggtttcgtcttctccgctagtccatctgtccacctgccaccgggaagacgccggagcagagctgggctcgacaaatggtcctgttttgtctcactttgtctccaccttggctgacttctcgacccatagatcgcttttatgccgccttgtatacgttgtgctggtgcaaggcttgcgtggacagtacaccgagtttacggctcgctcgcttataaggagaaaatgaaaatggaactttttccctttgctgtgcccggagaaaaacaaatggtggcttggtgcagctccgataaatactgccagtgcgccggttggagcgcctgccactagcgctacaaacgttcttcatacaaagtaggctaaaataagccgtcttggaaatgaaattatcaataaattccccgctattacaagtctactccagtaccgcacaatcgaaaatcaaaatcaaaatcaataaaacctgatcctggatgtcagtgaacctaaacctaacacgaaccaaatcaagagggccagtggtgtggacgatgtgagacgtgcttgtgctgcataggtgtcccgtacgtacaggcggaagcaaagtgcgcacacagatacgtggcgtttacgtagagcacgtatagacaaggtgggcgggaaccacggtcatacacagctaagccccactcactgtacacaccagaggaccctacttggaaacataaagccaaaaggcaaatcccaactgtcgcagattgtgacgacccaaaaatacggagaacgcagtaacagcttccttatcctctaaacctacttggcagcccacaacacaccttctgcttccattccacctacggtactttagcagccccctctccatcttacctagacagcagatcgcacgatctgatctgctgtactcgcccgaaacatccccatcttcttggtgagtatctctaccccacaatggcgctggtctggcgatacgagtcatggcgaaacaaacacgacgctattttctagttagcccggtctctccaccacaatatggcgatgtccccaaacgcggtggacgaggagcagacgcccacacggcccgaggctggtggtggacggcatcgtgggtggcggcacaataaccgtcatggtgggttacactctcccacaaggcgcgcaggtccccccgcgtcggtctcaattgcatggccggtgcccactcgcaactcgtcataccgcttctagacctgtcactgtcatctcagacacgtcactggcgctgtcactgtcgctgtcattcgattgttgcatatcaagacaagaaaaccgcactcttcgcgcagctcaactaactcaggccaatgacctaacattttccctccatctctctccccctccccccattcccccatcctatcttccccatcctatcttcccccatcattccacctattatttccaccccctccatcaaccctcccccttcaccctcacacctacccttctgcttttaacagccccatcatccatcccattcatctctctttgcctccgaaacgagccccatcagtaaatgtctgcgccaaaccccaattcctataacgactttgacgagttccgggatcagtaccaacagcaggcaataccctccgagctgcctagtcagcccatgccgcctctagcgacctacgaccaacaacagccgcacctacctatcgtatacccggtgccggtccccatctgctcgtactaccctcctgttgcgtcctatacccagccgaaacccaagcggaaacgtaagccgtcaaaccccaatgccccattgagtcagccacccacggcacgacccaagccccgacagtctgcgtacgccttatgggtcggcaacattccgtcaaactcacccattgactcgctgcggacactttttgcaaccaaagacattgagagtatttttatgattccccgaagccgatgtgcgtttgtcaattataagtctgaagaaggtgttgtcgctggaattgaagctttcaaccaaagaggaggacagatcagatccaacaaactagtagtaaagagacggaccaaggaccccgacacggatagccccgagccattgacggactcggagcggtcccagacctcttctccacccctcacagacaggtactttgtctgcaagagtctcacggtcagagacttggaggtgtcgcgagaaaactcgctgtggtcgacccagagccataatgaggccatgctcaataaggccttccgagacgggtccaacgtctatttgattttctctgccaaccgaacaggtgagttctttggctgtgccaagatgattgagcccatccctcctaaggagaaaacaatttcaagcgtcatcaccacctcctccagccatgtatacagtcctgtgatcaccatgacgccctcttccggcgagattcccgcaggaagaattgttcacgatgtcgagcgggcgtctctgttttgggaggttttagattctgtgtctaaacccgtagaagaggagtccaactggacttcgcccttccgaatccaatggctgggcaaccggaaccggcgtgtacatttctctgaaacgcgccacctcagaaactcgctaaactctggccgagaggtcaaggtggctcgagatggcactgagattgagccctcggttggacgtaccatagtggagatgttcaattgagtggcctgattgatggtcttgcgttgaggactatcaaaaagtaaaaaaacatcccccaagtgatataaaaagtaaaaaaacattgataaacacaagaagcgacgtgatgtgaccgtaatgtggaagttgtgtacactgtatgaccgaaaagcgctcgcccctgcgtacagtatgtaaaaacaattatctattttactatgtccttatccgatggataaataacttacaaacccttaccgtagttaccctcgaggtagaaggccttgatgatatcaacaatcttctcgagaccctcaacccaggcaacaaactgctcccagacaagagtctggtcctgaccgagcttctcgaacaggtcctttcggtaggggcaagacttcatggcgagcttgaagatgggtcgcactagcatggagtggtgcttggtgagggtggcgttgtaagcctcggtgaaggacttggccagctcctcgtccttgttgtcgatctgtcgtctcagacccacagcggtgaactcgaggcctcgcatcagccacagcagaccctgggtagcggtcttggtcttctcacccttctcggcaagaacgagatcctggagagtaccgttttggatggggttagtcatgagacgatcctggatcttcttgatgttaccgttcatgtcggactgaacaacgccaaaggcagtagatccgaataggtctgtgttagtttgatctgggcagtgactgcatcgggttatcgttgcagttccgtggtcatgacaagcggcctgcttttgttctaacggttgttggtgccccacagttgctgcagtcgctatgataccgctgatgttgctagggtgtcagatcgcgtgatctcaatatgggcgttgtttgtcacgcgttgactgtgacggtggacctttctcgaggcatctagcaaacaggtcgactaagatggaccgtccttctgtcacgtgtctcctttcacgccattgcgcccttggtcacggctcagaacactcaccgaaaagtccgacaaggtccttggaagcatccaggaactgggaggtgtcgaccttgccctcgacgatggtcacgtcctggaagttcttcttgttcttctcgaaaaaggtagccatggttgatgttttagaagtactgtagtcgactaatgctaagatgtgcgcgaggcgaggactgggctctctggttagggttggcacactgcagaaagttgtcctacgtgtcaacttaaagtgctgggtgtgagattgagaggggctagggtgtggtcgttgaaaggacatttgcacgtgatgtagcatggtttgttcgtgtcgcgctgtctttcggcggatgtgcggttagatcgcagctgttttagtatgccctcgactctctatggtcctctcgtataagcgccagtacaagtagctacagtatatcatgtacggtctacttggcgtgtatatatgcaaaggttcgcttattacttgtgcgggcacgtacaattgtagcttacacgtacattacaagtacttgtaagatttggtgaattatcacctgtttcatatttcagataagacatgcaatctttgggcattccatgtcacttgctacattgtagtcatatccaacttaccactcgcctgtctgtatgtgactacagtgtgtacaagtatggtacatgaatcaacaaagagtgttgacgaactctaatctgaccaggggttcttcatctattaaacgacccacccaagaatcgaactgataactactcaacacaaccccgggattacatcctgccgaatgaggaaggttcagcagtgcagcagatctacacaccagaaaggcacatcttgtaggtatagaactggataaaatttcctcatttgtacatttcagcaaaacggtcacgtgggtccgaggggaagcgattttttcggtatacaaactgaatagtgataagcacgggagtcaatagcaacactggtcacatgccccgtcacaaaacccgcgaatatagacgggtctcaccaggacgcgtggaaccacagtacatacagtagactacacatccacaagaatgagctgcgatatatttcttaatcgagagttgaataaatagttagcggttgtctgttcatagacttttaattttaggtagctgagcgggcaagcccctcctagtatacagacttgttctcccctggataagagtcttcgttttggtcagcaggtcgctcaacagaaggagcagggaagtagacagagtctgaaacatccacgtagttggtgctctgagcctcatacttgggcaactcctcctcgggggtgtccctggagttccagggcgtgtagttcctggtcgccagctgcacaggaacaaacatttgaatcttttgacgatccacggtgatatggacctcgagacggtactgtcgagatactaatgcagagtagaaggaggggatgaacttgggttttcgaggaatggaaacaggtaccctaacaaccatttcgaacccaccatcagcacaggggacccactcttccttcagctccttgcatcccagcaaatcgttctgagtcgtaagcttgaggataccgggagaactggagttgtttgtgcacgcactgaactgcttcctctgctcctcaatgacttcgaggttgggaacaaaactcatgccctttgaggctcggaaagtgtcggagtggattcgggtagtgatgagcttgacctccggcacatgagtgacaccagcctcaggcttgtactccagcttgatttcgacaggggatgtgttgtccatgtaagggccgttattggagatggcgtacaggccttggtcaatctcggtttgcgggattttgagaaccacagagggcgggacgtgggcagcaatgcttccaatctttttactactcatcagactcttctttttaaggtcgcaggaagaggagatggcactctggtgatgctggagttccacaacgggataggaagggatgacacgaacaggcatgattctctggtggttctttcgagccccttcatcccaaatgttgaccttgatctcgtagatgatagtggccaccttgccgggcacatctaacgctggctcttcccaggacagcgacgatcccagcgacggaggcagtcttctgttgagagaaagacctgtgagtcgctgagccacctcgggcaactcgtggggtacaaagagcgaaaagtccagggcgtatttgtggccaggtttcaaggtatctccttcctggatgcgttcgtagcctctctgggcggcattgagggtttcgtcggtggtaattcgttgcttcagaaagttccatgaggcttttgtgtcgtccatagtggccttgaaggacgaggtttgaatgccgcaaaagtggatggagagtcggtccactttgatgtctctgtcgggggtgaagaagattgatccgcagatttcgtctccaatgtcaaaagttcctctgcagcgcgggtctctgatgatttcaatggttttggacacagtgggctgcttgagctcctgtcgtggcaagggtgtggcggacgccacattgtagtacgagttgcacgacgtatcggtggtgtccgacgaatgtgagaagaaggactcggtcgagctgcgcatggtggtcattgttgtgtatctcaatgtcgaggttggatatatatgctgtaccagtggtcaacaacgggattcactgatatatatcgaaacgtgcttgtgagtgcagggctagagtgaggggggttagctctgcgccagtgtattagatgtcagggcaggcgagtattcgcgtgttagcagcgtacgccagactaagagagtgctctcaattcgctagccaagaaagtggtggtggtcttgtgacttgcaatttccaaggtcaggctgaggtgttgatatgcgtctacgggcgatattttatttgcttcatgcgggcacaccagcccgttgggatcgatagccgacgcctccaaagacagcagacctgggagtggctagtgactcatcctccgcgtggttacaaggcccgcttaactttttgtattttgtatttctagggcatcgccaaaagacacacccacataaagagccaaacttaggactttagagttatcgagatgaggggtgcaggtcttgctttaataaggcatattctggagggcgcagcgatataggggccggtatcggggagggaggaggagggagctgtggagggggttacacacacaattcccggatgaaaagccatcaagaaggcctacagaccttcctcttcaacaagactcctttgtcaaccccctccctttgtctctttcacgagattcactaaaaaattgctaccagtagcgccaatcgtgtttgctccggggacggacaccgcaattgaaccttgtcatgtgggtaaaaaagaaaactcaactggatgcgtacaataaagaaacaagtgcattctcaggaagcgtgattggtcccttgggccgtctggcgaatgttccagacacttggccgctgtcaagcatatcttcctcagccgtttccaacggcatgacagccccgtcgctctccgatcgcttgcttcattgtcctatagtgctcgtacaagtacaagtacatactgtacttttattcggtttcatgttctgtcttacacatcatcatctttaactgtattgtgacgacgctgtatcgaccaccattctgatgtttgggtacaactggatcctctgttatagatgcgccttgtcagtaaaacgccgtgctacggctgcattggtatcgatatacgcaccgtaccgtacagacggcgatgtttcagggtcacagctgctgtagggtatctacaatgtgtgccgtctcttgaagaagatgctcgctctgagggacgccatccagaacaaccacctcttactcggaccatgccagagtttgagtgctcccactgaatcaaactgtggaacgtgaataactcagcggcgctaaatgtgtggggtgatcacaactggactacaactagtcacagaagtgcaacagcagctaaagcaccgctcgaagcaatggctggtggatgtggggaggtggcgaacagtctatatcgacttttagacagaaccaggtggtcgagcaacaaaccaccagacctcggaatcccaggcccgtcaaatataatttagtattcagttggtccacgtctgacatgctcaactcaaccttctaccgaggccgttaacccttgcgactcagactcagattaaacagggtccgagtgtaatacagctccgagtcccgatgagagaattatccagagcgcgcagcgtgttccatggggatgaattccgaccaattccgacagcaaacacggactcaagttagtagtggctatcatctgacggaatgtagctgcctgtgtatatactggtactactttttagccccttttgcaacacttccgacggaactaccaccgttatagacggtgcaacaagactcctgcccccactccattatctccgctccgctagattgtccatttaaccgtacagctgacgggcataactgagcatcgacaacgtggatcatctgctagaccgagtaacgcgagagaaatggtaaatttaggagccgaaggaggtcaggagacgtattcaagcaaccatcgggtaaacattgagtaaatatttggctaaaaaatgtcccatgttccagcgttgtatctaccagtacactcactgtacttgtacatgactcatggtaaagctgtcacaacctgacaaatcaagcagactgctcatccccatgtgggagcatccatccttgcatactggccacttctttgtcaacagctatttcggtttaatatggggttcagaatcgattgccggcatatgactgacgagttatgtgtagaatgccagtcacattggttgtgcatggtgtatgggggcatgaacaacagatacagaatcgttccggtactagaatagaccatccttctgtatgagaccacgagtgtcagtacatacagtagctaatgcaacagaatatgtgcagaatataccttagcttccttcccatacaccttctcggtcaactacttgcactcgtactcgtactcgtgcagtagtagctcaagctgtgatatagccagcgaactacggctgttagttcgaatatcgtagagcgcagaatgactctcaaagcagcacaatctacagtacagccccgagccacttgcatgtatttgctcgtggtcatacacacatcatgccacttcccctcagatgcatgagtgtaccttccactacaatacttgtagcacaagaaccatatgtcaccagagcatacacggagatggagtgtcggagagatggacgtctttattcatcaaatcagaagtacaggtacttttattgacacttcaagaatcaggagtttaggagcttgaaaggctcccattactcttcagcgtgtccctccaacatatctagctcattatacaatgaaagggagcgtagtaagggacaagggtttcctccttcgttgtatgcacacaagctgtagtggatttggtatctcgttaaaccgccaccgtccttacatgagtgcgaacagtatcatttctcttaccaagagatggccaagagaggacactttatacgctcgacttttggagctatttgagaacagcgcgaggtatccatcaaacatgatctcttcgtcagtaacattgtacagttacacagcattgagagagtaaggcccagcaatcagtgttgctacaaaacgccaggggagatgaagagacacttcagacttttgagcatcatggcacaagagtactcgtagtacagtaccagttaagtcgaaagcttgaaaatagctacattactgatataccaatgcactcgaaaaagcggttgcaggttcctttcgtccattttgggtcccatatactctccgtgaactacagtatgtacgatgtactcgaggactggtccatcgaacctacagataccgcgatggtacgatacagttcttttattggtagatatagatgacatttggaacccggtgtgcttatacagcagttctacaactcctacaacggagccgacagctccacagagtctctgacctcgctctacacaactaatgctctaacacaggcccgaaggtatatgagagaagccgcggttcaaggtaacagggagcatatcaccgggattaccggggaaatctgaagaccaaagagaccagagatacacaacagtcaggaggcatgttagttccactccatacaaactactgtacatacgtgcacctacagtacattcaaacctgagaaagatcatgagatatctgtaagtgcacaacttcattcaagtccagtactcttaccaagatatatcatcaccgtcgtattagacactttccaagtcatgctcttctccacacctactgtacgatacgaggctctgtctggtcatgtgaccttagttaaattgcatatatatacatacagcacacacatcttctttcctcgtctcccaactacaaaactctaactaactaaacaccactgtaaaaaaattaggagctagtggtaggtagtggatctgatgatgacgtgataatgcgaggagaaatgggacagctttatagaattctacttccaaaaactgaatacaagcaccacgccctgtcgcagccctctacttctgcccctcgtcacaaccacaatcccttctttttgcctaaccctcaaagttaccctacctgcaagtctcacacgtctgctgaaaaatttctagttacacctaccaagcaaccacaccaccaatatggctccccatcagaacgtccgtcccgagacggtcttgaagcgaaccgacgagcttattgccgtgggccagcaggatgctgctctggagcttctccacgagactgtgtctgcccgaaaggcccgaaccacttctgtggctactctggagcccatcgtggctcgatttgtgcaactttccgttgacctgcgcaagggcaaaattattaaggatggtcttcaccagtacaagaagatcgtgcagtccaccaacgtgaacgccattgagcctgttatcaagcagtttctgtctctggccgagcagcgagttactgatgctcaggcccaggctgacaagattgccgacgaggaggaggctgacgatctggaggccgaggagacgcctgaagacctgcttctggccacggtgtcctccgaggacaccaaggaccgaactgaccgacgggtcgtaaccccctggctcaaattcctgtgggaggcctaccgaagcgtgctggacgttctgcgaaacaacagcaagctggaggtcatctaccagcaggtggtcgagcaggccttcaacttctgtctgaagttttctagaaagaccgagttccgacgactctgtgagcttctgcgatcccatctgcagaccactgcccagaaaggccccaacgctccccccgtgaccgcaacttctgtcgatctgtctgatgctgacactctgcagcggtaccttgacacccggttctcacagctcaacgtggccgtcaagctggagttgtggcaggaggccttccgatccgtcgaggatgtgcacaccctgctgacagtttccaagcgacccgccaagcccctgatgatgggtaactactacgagaacctggcccgaatcttcctggtcgccggaaactacctcttccacgctgcggcctggaacaagctcttccacctgctgtcccagtctccccgaggtgccatccccgtgtccgagtaccagcgagtcgcctcttttgtgcttctgtctgccctcgccatcccccacaactccagcgccgaggatcgataccgaaacacccggctcactggtctgctcaacctgcagcgaacccccactcgagacgctcttctcaagtctgcgctgtcccgaaacattctggctcacgtcaagcctgagatcaaggctctgtacaagactctggaggtcgactttcaccctctgtctattcgagccaagctgacccccgtggttggcgctatcgctgaggcccccgagttcaagccctactttgcccctctttaccaggtcattctcacccggctcttccagcagctgtcgcaggtctacgagtccgtcaagcttgactttgtcatccagttggctactttccctgcccctttctctgctacccctctggagattgagcagttcattgtccgagcctgtgctcagggcgagctggccattaagattgaccacgaccagcgatccgtgctgttcgaggaggtccgagccgccacaggctctgcttctctgcaggacactcccattgaaattgttcgaacccagctctctcggcttggtcgaactctctctgttgctgaccctctcaactccgccgaggctcgagagcagcagtacgtggctgctctcactactgctcaggacaatgctgagcgagagcacgccgagactctggctcgacgagctgaaattgaggcccgaaaggcccaggctgaagccgagcgagctcagcgagaggaagaggaggctcgaaagcgagctcagcgacttctggacgaggagctcgccgagaaggagcgtctggctgccgagcagcacgcccgagagctcgagcggatccgaaaggagcaggacgccatccgagaggaggagaagaagaagctggccgaggagatcaacgcgaagggtatcatcactatcgatctcgacaagctcgagggtctggacaccaacgctctgcgaaagatgcaggtggaccagctggccaaggagaccaaggaacttggagaccgactccgagtcactgctcggcgaatcgaccacactgagcgagcctaccgaatggaggagatcaagctggtggaggacgactttgtcaagcagaagcagcgagaccgagagatctacgatactcgaatcaagctcatcaaggacaccgccaaggccgagcacgacgccaaggtcgagctggccaagcgtctgcagcgagccgttcccttctacaagtctttccgtgacgatatccgtgtcaagcgagaggctgagtttactcgtcttcgagaggaggccgtcaagaatctcgccgaggctaaggctgctcgaatcgaggaggtcaaggccaagcgaatcgctgacgccaaacgagctgaggaagaggccaaggctgccgctgaggcagaggccaaggctgctgctgaggcggaagccaaggccaaggccgagcaggagatgcgagagaagctgctggcagagaagaaggcccgagaggaggccaacgcacgagccgacgccgcctacgagaagcagcgacagaaggaggccgagttggaggccaagctggaagccaagcgagccggcttctccggagctggtcgacaggcccctcccagcggtggctacgttcctccttcgcgacgagagggtggatacgtcccccccagccgacgaggagatgctggagccgctcctggagctggctctggaggttacactcctcctagccgacgagaaggtggcggaggcggatatgttccccccagccgacgagaaggtggcggaggaggctacgttcctccttctcgacgtgagggtggatctggcgctggatctggaggccgatatattcctccttcccagcgaaactaaaattaaaggtgattggtatagattaacaactgatttgttgagatacgaacaagtagaacaagtagaacaagtggcgtttgtgaaagtactgtatgagtacacatacttgtaacggtacatactgtactactgtagtagagtagagtgggagctgtgctccagatagatagcaaatgcaatcagaaggtgggttaaacaaccatacaagtaaactttcattgagatgcttggtacacatgagaggggcgaggcatgttgaatacgaaagcaagctcgacagagtgggctatcttatctgaatcaaatggaacgatcgagaggtgacatgtcctatattactacagtacaagtagagagtacttgtagttggatatgattatggcactgtgttataaaaacgccactctcggggacagcaaccttcagaggcttgcttttgggcgttgagaatggactttcacggacattgtctgcagcgccaagtggctccgttttcttatcttgcagttgattgcacgagggtttcatcaaaaaaccacggcacgcaaagttcagccgcctgcttgacttgacgagaggtaacctggtgaaaggcgcttgtagaaagcggctgaaactgcccacccgagccgtccaaccgagccactactttggctgaaaacgaaattgactcgcagtgcgacgtaaaaactggagtatggtgctgaaacagaactcatccacaaccaaaacgatcacaattgctcgcctacttgtactggtacgttccctatctttttcctctcgtaatgtgaccgttttgggatttagtttacaccagggccaaaagtttgataaggaatgagagcgaatctcaaaggtgacgtagatgttggagcctcgaagccgtggtccctgcaaccctctacttgatttgcaaaactttttctgtttctaatacgtaaaaagtttggaatgtctccttatttcaaatcttgtgtgctcgccgacgaacaagtcgtctttggatcaataatggatgtgacactgtctagtttttccgccccggctcactagtgctccgtctgttagtattcataatccgggtcatcatacgctataatacactagttgagttttttcatccgctattatagctcctcagacgggaactagccgggagcggaacgttcttcatgtccccggaaacgaaaactttggacatggtagaattacagtgggtggcgctacattctaaggaggggaggtaatagtaaacagactgggtgtgatatgtccgtctggttttcggactagcctctgcgtcatctctcatggcgcaaagtgctacttgtagtgtaatgcagagggctttttcggcggagttcacgtattcacgtacagttgtattcaccgcagccaagacgggctagtcaaacagcctttaacaacggctaagctcaaaagtcctcgaaggatgggtgcagtcattgcagcccctgtgtgcagaagacggcttctactcggggagaagagaggtgtagagtggtgtagatcgtgccgtgccagtcagcttgatgacaatgataatgaccttctaccccacaggcgggattccgtgtctgtctaaagcctaccgtgaagcggctaacaaggccgcagaggctaatatcgagtgtcttttgggctatggtgaaaaactaatccctgggctgctgtttgcgacgaacggcacctcacgtgagtttacacatgatgctgtctcatgtgtcgggataagcgccccgatgccgatggggggaaagctctttgtgagtaaagcttgtaatgcatgggcccggtgccgttcagtacgcatcgaaacgcccgtaggttcatagctccgcggtttcgacaaggctggcttcactttaggcgatagtttaactggctcgaagtctgagcttgcagccctggcgtaggtggagtgcatggctgagagagaaatatacaccttgtctgcgcttgtgatacgtaaaaaatgtatgaccttatcagtcgtgtggagaggagggtgggtagttgtgcaagacccggattgggcgacattcattctttttgacctcgattccttagcccaacggctgctgtggttcatctgacaaatggcttggcagggtccgcgttaatccgcttcggccagcactgtgcaggacatttttcttgtgtctggaatcattttcattgtttggtggtggagcatgaactctatcaaaaacgatggtttggtatcagagttgcgttacactgattggcttactctcgaggtatggggatagagaatgatacagccctacgagatggcgacaagatatcagcatgtttatttacatggggaccacttcaacaaacggcacaagaccagattcgcgttcgcaatcctcaattacaatctcttggcgcttcgcaaaacgtcagccaagtggcatggcactgcaatctgactcattgacaagacagacgcgctcgcttttttgaagtctatcagacatcccaccaggcacggcaccatcggaagtagagtttgatggactcacgcgagagactccgcgataatggacagatatatatggtaatggggttctcttgggctggtttagtagagctctctctaatacttctctctctcactcacacactatgggttacgacgaaccccctatcgactactacgagtcggcagcagaacatcacgtccagaacgatgttgcttctgggagcatggaaaatatctccgacgaagttgtttacacaaccgagcctcctcagaccactgatgagaagaaggaccaaaccgactacgatgccagtatcgcagaggtatccatgaccaccgttgagtgggttgctcagcaactgctcatccctccctccgagctcgatggatcctaccctgaagatgtccattacatggctcgaaaggttgaggaaatgtccaatgttactgccgccagtatcatcagagccaacattgactaccacatgaacgacaagaacttgcctgctggcatgatggacgagtgccgtgaccttctggaggaatacacacatggacctgagggcgagaaggaggacgagatggtcggagactatgccggtgatgacttccagccagagaactctctcatgatgcgatactacgccgctctgttccacgactggtctccttatccccaggttcgatctgtcaccacccccattcctgcagaccccaatgagcatgtcgagaccattcgatgctacattgtcggaaccatctgggttgctatttctgctttcgtcaaccaattcttctacccccgtcagcccgctatttctctaaccacacccgtgctgcagctcttcctctacccctctggtgtgcttctgcagtacattctgccaaagtggggattcaagctctggggtatcgatttcgccctcaaccccggcccttggtccgcccgagagcagctcatggcaaccctcatgtgttccgtggctgccgtgcccccttacattaactccaacatcattgtccagtacttgcccatgttctacgaccagtcttgggccctcggattcggatacatgttcctattcatgctggtcacccagtacatgggttttggccttgctggtcttctgcgacgagtggctgtctaccccacccgagctttctggcctacttccctgccgacccttgctgttaacaaggctcttttggacggtcaccgaaaggaaactgttagcggatggaagatcactgagtaccaggcttttatgatgtttggatttggtgccttcctctacttctgggttcccaactacctgttcacagccctctccactttcaactggatgtcctggattgcccccaacaacatcaatttggcaactgtcaccggtagtgtcactggaatgggcttcaaccccatcgccacctttgactggtccgtgatcaccgctcttgtccagcctgtgtacatgcctctctacaccattgtcacccagtacgttggtttcgtgcttagtggtctatgtattcttggtgtatggtactccaactactacaacaccgcctaccttccaatcaactctaacgacctgtttgacaacactggccagccttttgaggtcgccaaggttctcactaactcccagctggatgaggataagtaccacaactactccccgccttactacactgctgcaaacctggttctttacggtatcttcttcgcaatctaccccatgtcattcttctactacgttgccaacgagtggtctgtttgcaagcagtccgtcaaggatatctggctgtctatccgatacctgaacagatccaactacgagggtcgagatgatcctttctctcgacagatggctcagtacaaggaggtgccagattggtggtactatgccatccttatcgtcatgtttggtcttaccgttgccttcgttgagcactgggaagtccagactcccgtgtggtccattgttctgattctctgtgtaaccctggttttcctgttccccttcaccattgtcatgtctgccactggtgcccagcttaccctcaacgttattttggagctcattatgggttacaccattgctggtcgacccattggtatcaatgtcgccaaggcctttgccgttcagattcaggcacaggctcagaacctgtcttctgaccagaagattggccactacatggcccttcgacctcgatccatgctgcgggttcagctgtgggctaccatggtcaatggacttgtcaccatcggtgtcatccaattccagctgaccaagattgaacacttctgtgacatcaagtaccagaaggagcacgagaagttcacctgtcccaacgagcgaacgttcttcactgcctctgttatttggggtcttttcggacccaagcgaatgttcgacaaccagtaccccgttcttcgatgggctttcctcatgggttttggcgtcttcctgctcttctggggtgtccagacggtccttccctgggcgctagtcaagaagtatccccagaaggagcgaaagattcgaaagtggcaggatcgacttatgatggtcaaccctgttctcgtcgcgtttggtggtctgtcttgggctccttacaacttgtcctacatgactggtggtctttacattgccgtcctgttctcttactacctccgaaaatactacactgcgtggtggaagaagtacacctacgttatcaatgctgccctcaccactggtaccgcactctctggtatcatcatcttcttcgctgtgcagtacactaacaaggatctgagctggtggggcaacaatgttcctttcgccggtcaagatggtgctggaccccctctgatggacatccctgccgaccctggttactttggcccccctccttctcattatccttaagtgggtactcggaagtatcgtttttgcatttgtctattggctgtaaatatttaattaatattggtgatttatttgttcaactattgtgttcactgcactccaattacaatatcggcgcgtaaagtccaagtagatgcgtggagtgggtaagtactgtagtcaattgaagaagtagcagatgataccagcacagagagcccttctatcgtacgaagtactgtacattattcgaactatgctgcatcagagtattcgagcgttactcactccaaggatgtaaatgggcacattaaatgaggaattgatatttgaggacagttgaagataccaatgcagttacgtatgttgcaaatttagttctccgatcatgtttcggaacacgtagaaaatgcttcattttttgcttctgaggaaaacacatttcagctacattgaacagaaaaagctacatcgaacagaaaaactcgcggggtttgttgtttttatattctacttgtagggaaatacatttcagctacttgaggcctataaacaatgttatacccgcaaatcagattcggattcggttgttctttttttccttttttatgctaatgattcattacagctctttttttattctagtggttcattacagctatatactgtacctagtaagccgggttattggcgttcaataaatcatacacttctgaatctttgcggtgtgcgctgcgaggcgctgtcagttggtttgtcgacgcttcgtctagttgatgtcattgtcgtggtctcgtggtaatgaatcatggccaacagatcaagaaatcatatcaatcgtttcatgtcttatccagactcgaggtcggtttagtttgttctcataaaagatcgtagacggtgtaattcggatagggatcatgaatatgattcgtgtgtgtcatgtttgagtctttgtgccatcggggagttgaagttggggtagctcggtgtttggtttttttttttttttttttttttttcatttttttttcagatctttcatctatttcagaactgtctgtcaacagtttcaatctcaaaaaaaccggacttcgtggccaagttggttaaggcgtacgactgttagtcacctaaatggccgccatcgtaagatcgagagttcgaccctctccgaggtcgtccgattttttttcatttcatgcttgtcaaacgagtagtttaggctggtatcgtggtcatatatattttgacatcctttcatcgattactaggtgtactatcgtaggtacagtagctcatcagaggataaggagttggagctacgtgcaagcaacacatcactatcaaccgctgtcaattacacgctcacattgataagtgactgggcatcgacttacgaacagggaattgattgctctggaaatcgaaagtggttgcaaaactgtgttgcaggtgtgcaaatcggtcatcatttatctccacggcgttctgtttgactcttgaaatcaggaacaagcaacaagagatacagcaaggccatatcaatggtacaagcccttgcactgctcattggcaaacaaagggaatcaagcgggaggggggaggtcataaacccctgactgaggactcctatgatccccttatcgtggcatgtgttcaagaatcaatatccaaggatgctctttcccaaccttgaggttcttggctcttcaccagtaaaccagtgtctcagtattagcttcaaagagatatttacggctccgtcctctacggtacacccacttttcagccttacagagccgcggtgacgatctccttcggagtgggggacaagcaaaagcgcgggagctgtccatctacatccggaggttgaagatccagacccacctgccatcagtatcaattaactctatcccatgagaaacaatggtcagaccattgaccaatatcacttccaaatatatcttgcagtacacttttttgctcaattgtctctattttttgtgaattattgatacactgtagctattcatagtctctcttcgtgaagcaaccagagagaaaactagacagggcgagcgctctgtaagatcaattacatggattaatccttcatcttccacgcttacatgtcccaattgaccagcctacgacatcatatggtggtactcgtactgtattcgtaccggcaccggtacttgtaagtgcataacaacaaaagtcaacaatatcaagggaaaaaaggaccgacctggcacagttgccccgttacgagctgtaaacaaaaaccgtaaaagttgcttcgttcccatatagggagatcgacattggaagctttctttttcattatttgtcgatccctgtgcaaaaggagaagaacgcaaacggaacaaccttccaatgttggcgttttggagacttgctagggggtatgtagtgattactagtagtttttgtaaagaaatgtttttgttaaatatctaagaaaatttattcactatgaaaacccaggttaataaaggggtattgaataatattaaatgtatactgctttctacttcataatttagaaaagagcaaggataccagcagcggcaaggatagcggcggagataccgttggaggcagcgccgttagcctgggcagggccggaagagggagcctggggagcctgctcgggggtggaaggctgagcctggggaacctcgggcttgccagcgggaggagcagaagcctcgggcttgggggcaggggcgggaggagcagaagactcaggagcaggagcaggagcgggggcaggggcgggggcgggggtagactcgggcttgacggcgggagactcaggagcaggagcaggagcgggaggagcagaagactcgggcttgggagcgggagcaggggcagactcctcaggcttgggagcaggagcaggggcagaagtctcgggcttgggagcgggagcaggagcagaagactcgggcttgggagcgggagcaggagcagaagactcgggcttgggagcgggagcaggagcagaagactcgggcttgggagcgggagcaggagcagaagactcgggcttgggagcgggagcaggagcagaagactcgggcttgggagcgggagcaggagcagaagagggagcaggagcgggggtaggctcgggcttgccggcgggggactcaggagcaggggcaggagcggggggagcagaagactcgggcttgggagcaggggcagaagtctcggggacgggagcctcagtggtagtatcgcaaggaacggtaacagtcttggtaactccctcgatcacagtgaccttggtagtgagagaaactccctcggggtactcggaggtaggcttgggcttgggggcctcggtagagtggtgcttgcactcctcacactcctcagtgagagtgacagtcttgccctcaacaacggtgaccttggtggtaacgggggcagaagtagcctcgggggcctcggtgggggcctcagtggagcagggctcagtgatggtgacagtcttaccctcaatgacggtggtcttggtggtgagagaaggagcagcagtagaagagtgcttgcaagtctcacactcctcagtgacagtctgggtggtgttctggacgggagcctcggaggtagggacagcctcaacggaggtggtaggaacctcggaggtagtagggacctcagtagagcaaggctcagtgacagtcacgatgacagtcttgttgccgccgtgctcgcactcgtggcaaggaacggtagaggtcagagtcttggtagtccaagaagcaacggaagaggaagaaacagttccgttggtggggacaggggaagtagcagcctcagtggtagagggagcgacagaagactcggtggcgttggtgggagcaacgggagcggaggtggggacggcagaagactcctcgggcttggaagaagcgggggcagaggaggcaggggtagaggaggcaggggtagaggaggcaggggtagaggaggcaggggtggaagaaggagcgggctcagtggtggcaccctcggtagggcagacggggatgatgggagtgggggtggcagtgggggtggcgacagccttgcaagcctcaacgtactggaggagctgcttgtcgacgttgaagtaaggccacatgttgtactgctggacacaagaagtgcactggtcaacagcagactgggtggacttgatcttgtcacagatgcacttggcatcctggccacaggagttgatgtcagcaacaacggtgttacaggtcttcttgcaggtgagcttgccgatcaggttgaatcgcttgttaagcatgttatcaagagaagcggggtgagaaggctcgggggtacaagtgggaggaggaacctcacactcgggaagagagctggtaacatcggggggagtggtggtgacaacaacgggagggggagcgacagaagaggtggcctgggggtggcacttcttaatgacgtcgtcgatctcctgcatgccgtactgggggtaagcctgagcacaagacagacacttctgggtccaggcgaagccatcaaggaactgacactcgcaggactggagaccctggcaggtctgcagaccgaaagagagcttgaagcacttggtggagcagaagacctgggacaggagggccagagatcgcttctcctgagcgccggcgggggcgatacaggtctcctcaggctggggggcaggggcagccgaagaagcgggaggagcgggagaagaagcagggggggcgggagcctgggtgctgggagcgggagcagggggagcaggggtaggagtgctggactgcgagaaccagaaagtgttagggtcaactccgccggggttaggcttgggagcgggagcggcaggagggttggaaggagcgggggctccgggagtagagggctgggagaaccagaaagtgttggggtcgggtccctttccgaggatagggtcggcgacagcaacgctgactgcagcagcgagaagagtggcagagaacttcattgtgtcttaatagggtctctcgacttttgaaagggtattaagcgagtgtggtagtcgaaatgaacacaagtgaatctgttggagttgtaagaaggaggacgggtagggtatttatggactgccaaggttcgtacagagtgtattttgggtctcagacgcgagcactgtttttcgctgagctggtcgtcatcctttaggcgcaatggcgatcacagtgtcgatcttttgcatgatttgcattccggtatgatgatcggcatagggactgggcctgggaggcggggagagcttatggtcatcactttggggggtaacacaataatatcatggtgacaattggtatgatttgttttagcggctggttgtgctggtcggtgcaagtcgtcttggcgccgttgtgtacctgacagggtggtgtgtgtccatggcactaaaagtaggggctattaactttatgcagggccaaatattactgtagggggttcttacacagcacagaacagcccagaacacgtcctctcgctacgattgtattgggaccaatgtcatagattggattagggggctacatgtcgcgttggtgtgcttggaccctgctgtgggtgtttctgtggggtgcttttgtttcattcccacgcaacggtctgttataggtgtgggggggtcaacaaaatgagcatttgtttatcggtgcttgcgtaatacagtggctcgctcttttctctctatttatttgtgtccatcctctttggcacttgcacacacctctctgttttgtcttgtctttaccctccgcacaagcatgatgatgatccgtagatccttctattttaaccaaaacctaagccagggcggaggagaggtgagaccaactttagttgatacacgaccacgcgttttccccggctgctgaaagttagagcaggggtgacccccagcagggcgtgaaaaaataaataaaaaaaatgccgttagaccttgtcaacaaagtagccagagaaggtcaatgggtagtcaatgccctcaatcgatatgaaaacctgccacgcaggtttaagatgtgcgccaagagctagccctcctgaaaaacttgctgatcgaaacctgtgtgcatcagacagctggtctgtcggtcagtgagaacccatccctccgtttgtgagggttttgcttgttgcgacgatcttcatttttgcttgttagcgtcagccgccttacacgaacacgtctttggtgatcgacactgttgtacccaaactcagtgagctgtccgtttctggcctgcgagagaaaagagagggagagaaaaaagacggaaaaacgaagtccccaaaataacatccacgcaacacgttaacgagatgcagggatcgatgactggcctgaactaaacatgatgctgtggctggttaaagtcccatgctgaatgttgaggatcaatgggttactggagtgttgtatggttgttgctacggtttttgggccgtaacatctggtccatagattaatcgtatagtccatcgtactatcaattagcaccccttgtcctggaggtggtgatcttcacaacaatcacgctaatcagcaatgtcgatcccaagcagcgtgtttggttggaagagttagtgatctgcggagaaagcgaaccattacaaaaagaaattccaaatagggaacccaaaacgcctgtttgttgctcggcagtgtgcgacgtggtgaagggagtgcaaggcacgggcaggggaaagagaaaaacaacagtggaactttcaggcacagcaggggggtgttcctggaatgacaacggcagtggagcactaccggtgcacgagaacggggatcaccatcgatatcaacttcgatattgatagcggttgtgcagatggcccctgatgattccaccgattagatggctatacatgagaacttcatagctaatgacatgtgaagataataggacagcaccaggaccctcttcatctttgttgctcggtacttgtacatactaggttcttttgggttgttgtttttcacgccgtcgtagtcactccgcttgagataagtgcctcgtcttgtcggctagcccttgccccgatcgaattgggccgagttgatccgttatatccggtaacttcttccaaatttagttatgtttgttgatttgggggtgtatggaaaatcgaagagggtggttcttgtagccatgtaccaaggcatggaagcgtcattgtgcagtccttgagggattagcgaaactcaaacgcacaacgacgggccctgcagttgtttgtctggccaatatggatttctttttctggttagtgggcccggcgaggtcggtcgatatcacagcaattcaactaattgccaacattgtttcccaaatatagaacaactgcttgcccagagattggcaaccagacaagggtaagccaaatgacctgatcgaacacaacagcgctggcacaccgagggccgtacacacatagccatgtgatccacatacaggcgacaatcaaacggactatccatggagctatcagttcacccgtgccacaatttgcactgtacaccgtcgccagtgctggttaccaactcgatgatgttcaactgcggacagactgatctgccccagccctcctgaaagacattggacgatcactgtaccggtcggagtgggacgacccatagtgtcaatcataattgatgccccccaaagcagtatgaccactgtctagaacgtgtgaaaccagacacccgggtgacatggtacagtttcccgacttgacttaatctaggtggttcattgcctccaatatcgccacgagagttcttatccaatgcaccgccttaacaggtcatctctctgctgcatcgcacgagtactcgtacaattgctgcagcggaagacgcaggtgctcatcttgggatacagctgacaatgccagtgatacaggaggctggctggaccatcctctttttggtccacgacaaaagggcgtggaaagtatttgtctagatgctaatgtaggttgaaacctgtcccagttcatggcaaggtgtaacgaggagtagcgtgtgtcgtacagtatatgtgcaaacaaacctctgacatcgtagtcaaaccacatggagtaattgatgcttgctcggagttgcttgcaggtactgctatgtgtcactcgcacaagtatacgcagtacctgtactcgtatgtactgtagcaatagggaaagatcactttgtacaatgttaccaaccccactctccgtgcgagtataaaagcaatcaagaagatcagataggatacccatgcgcaaatctctcccttttagtaagtgcccaattgtgtctcatccaacgtatcccccaggctaattagatcacaaaggtaactgctccatttacaagtatcggttagtttgagaactcatttatacgagaagtttgatatccaatatcatgtctcacagtaacgattactcttttgtatctttcttagttactacgctgtttccaggaatagaatcaaaattgggcattaacaatgtacgacaactccctaattatagacaggccaatagccgtctgaattacaacagctctacccggccaaaccactgtactagcagctctacgtgcctagcccaacacggcgcaccatctgcaaggttttatctaacgtacaagtgacatttagtttcaggaacaatcatgactatcagcttctgctactgtactcacactcgtactcgtggccaagcctttagccaaggtcttccgcaacccattctcattatggtaacctgtttgggggatcgtccacgaccttaagcgaagatcccgtccatcacgactttcttgaactttgagttacgttgggggtcatatttcttacatcgaagtcaccgagtgtaactatcctcccaactttttctctaccagtcaaaacaatattgtcttggagtaattcccacattctccattgggctatatttctacaacagacagtttagcgcgatacctcttgcgtattatatgcaggcttttcgtttgtcttgtcccaagatttccgagtgcacggaaccctaatattgcttattttagagggcccagaggtgaaaaaaactaaatcgaaaaacgaacccaacccagagaaagggggttagggtgcccacctctcgtccacaagtcatgtgatcatcgtcgagaaagtgggtcggacactccgaaggctggttgttgttgccgcagttaccagcgtcgtagttacggtttgctccaaagttcgtacacacatagttgagcacactgtagaaacgttacgtaacgcgacacagctcacattcacgtctaagcctccattccacgagaaacgtacatacacgggggcctgactaatgtccatccatgatgtgatgttacgctgaagtgaccgacagcgtgagaaatgtgccttgcaaagaatcgatcgtactgtagcaatcatccaccagatacaggttaaaagttttcacagttacttactgtactgaacagtagtgacagcccactcaaataccgcaacgacaaatagcgtcgtggagggtggaaagagtgataaattatcgctgataaaatcgcttgccttaagacccatgctcgctctcctacgactacgcctactctaccggcggtctcattgctgtctgccaactgtagccgatacaatgtgcagtgttctcggcacgattttgtaggaggcataattaccggttgaactaaaaaagtcaatttttttgaccgaggcaaacaaacgctgccaccgagagagaatctttgttgactacaatgtagaaaaaaaaaaaaaaaaatggctgtgcagaatgcagccacatcatagcggcgagtgttgaaaatagaaggcttccgaaccgcatccgcattacgtaattggtccggtgtaacgtcttggttatggaggcttagcaatgtgctatgatatgtaaggcacaagtcctattgttacgtagtgcaagccgacaagccgatttgagggtatacctcagattatgagcaataaagtgagaataccgacacatacacagggagttctacccactagtcatcaatgcaatcgctgccttacgaagagtgtattcgtacagtgttctcgtctaggctcaatgagtgagtgctcggtcaagtttcggcagagaagtactcaatgcatatttcgttgcatggaccaagaagtactgtgccgaagacgagacaacgtactaacggtatcaatcataggctgaactaaaggatgctaaattagtccctccgtccattagtcagttgccgggtgttcgttagcgcggttagtaaggggatgtagcgtaggatagctgggtcagaggaaacagtaaatgtactatgatagggctgtgaggttttcaggagacaaaaacggcccattcttctgtcataatcacctcgctcactccagccaaagtacggttgtacttgctcgggtcggcagttatactttggctaacatcgccaagagggaaaaacgcagaaaagcggaaaaaaaattaaatcgtgattttgcaccctcgaaaaccacagccaaccattctaaacgtttcagaagcgccgaaataacgcccttttcacgcgtcccgcacccttccaccctcccacaaaaacacccgtgtcatgtctgctgcatctactggagctagcgccaccaagagtgcgcctgttagcagaaccgcccagggcactcagtctacacctgcttctctcaagagcgaaaccaagactaccgaaaccaattctaacatcaccgacaccaacggcgaagacctgttggcgttctggcataatggccggtttggcgccttcttcaagaaacacgaaatccccagaaagttcctccacacctccatcggcttcatcaccctatggctgtacacccaaggcatcaacctgaaccaggtcactcccgttctcgtggtgatggcattgttcatcggcacctttgacttcctgcgtctcagaaacaaggccctcaacaaggcctactgcaaagtcatgggagctctgatgcgagagtccgagattaacggcgtgaacggaaccatctggtacctgcttggcctcattctggtcttctcgttcgcctctaaggatgttgctcttatggctgttcttctgctctcctgggctgataccgcagcctcttccgtcggccgggcttatggatacctcactccgaagtacaagaacaagtcgctggctggttttatgggcgccttcattgcctctgagatcgcatgtctctttctatacggcatcatcatccccaagtacggcgctgaagtcgacacgcccggccagatcacctggtccaagcagtcttctcgacttactctgggagtcttgacagccatgtctggtctcgtcggagccgtttccgagtccattgatgtgttcggaatcgacgacaacttcaccattcccgtcctctcggcgctcttccttactggtctgctggacatcttcaagaagtaaattggctttcactccccgaacatcacaaaatcaacacaacaagcgatagaatgacgacaagaagaagctgacaagagttgcggaggaatagtaatagttttttgcatatagacaaatagatagataaatttctcttatgactaaccagactgaatgagttagcattgagatacgtcctataaatttcaaattgtgcatatcggaagccatcatatacatggttcatgtaaagcatggcagatcgatcagtctatacagtaactgcagtaatagtagggtatgtacccacgttgccgctcagatagtacaattttcattacattgcttgttctatatatatatacaagctcaccttatgccaggctcttcaacacgagctgcttctgaatgtcggcaacccgatcacccagcgacagagccagaccctgacccttggaccgaattcggacgtgtccagaaatctccaggttgtcgttgatctcaatcgagatgtttgcaagagcctcctcaccaaacgaactgatagagtacaggttagcagaaaggaagccgcagtcgtcctcaagatcagtagcatcctccttgatggcaccaggagtgagacacttcatgttagtgttctcaacaaagtaccgaatgtacttctgaagagtaagaccctttgccatgaggttgaccttgttctcccattcaaactcgctccacatgcttcggaactcagtctcggagcaggtggaaggcttgatgtagtccataatatcaacatgcagatcgttgagaataacaaccttgttgtccagagaagactgaccgtcgtagacaatgttaccgaaaatgacagacgcatcagcagaagacaccttgatggtggtctgtagagaggcaaatccatggggaccgaggttgagactctgaggctggtcaacaaccttgaggtcaccaagcacagagaactccactgtgaggttccggagggtgtccttggtctggttaacaagcagaatgtcgagaatgatgtcaaactggtgcacgttgatgacggcctcagcgtagatagggtcggagaatccagtgaggggctggaccttggcaagagaggaaagaggcttggtagaaacaacagtggtgtcgatagtatcaagagcctcgggctcctcgtcgtcaccatcagtcttgacaagctgtcgaaaagatagggagtcatcgacttgaacggcgttgtttcgcttgtcagcagccttcttgtcggcacgctccttatcgagcttgccaacaagggctcggaaggcctccttcgtgtcttctctgtaggcctccacaacggcaggctctcggtcgccctgagagatcgctcgaatacaagacaggattctgtcagtagagtcctcgtcgatagaaacagcagaaaactcggactggccagctcgcagaatagaggtcaggaacagcatggcctcggccttgagagcgttgacccgagcaggctttttggtgatggcagcgtatcggaacaccaacttggcgagagtggatccaagaacgccggcaacaaagtagttgccatccttgaggatgatagaccgcagaggttggccctcaaactcgtcaacctcggccttgacagtggtggtcagggcagattcggtggcgtaagtaccgtcagcaagaacctttcgggaaggcttgtgggtggcagtctcgccaacatcgggctcctcctcggcaccattggtctcaccgtctctctttcgtcgctcagaagcaacaatgggaacctctccaagagaatttcgaatgtgctgccatgcctcctggatgtctgcttcctcgagacagtactctccaatgacccagagagcagatcggtagacagtggctcgtcgaacagaagacagagtggtcaacagtcgtcggacgatagtagatcgtaggttggggaaccgctcgacaacctctcgtacaaagatgatgacatcgttggcagaagaggagttgaagtcggccacaaagtctagcagcagatcagcaacctgggcagccacctgggggaacttgatggagcagttgtggatggctcggataagaacctgtctgtactcggcgtttcgctcgtactcctgggagacggtggcctggagctccttcttgaagagcttaataacctcgtcaatgtttgtagaggacaccatgtctagggcaatgtcgatggccttggatcgcacatccagatcggcagacgacagaatcagcagaatggacatggacagctcgttgagaattcctgggtttcgtcgatgcagggtatcaactcggtccagaacaatgagcttgacgttgttgtcagactcgtggatggcgagatccaccagctcctgggcggcagctcgcagagcagtggggttagaggtgagggcagtcagggccatggcagcctcgtaagtgacggcgggagacgaggcctcgagcatctcaagtacgatggcaatgtaggactgcttcagctcgggagtgacaatggcgtctcgtcgaatgaattggacaaacgccagctggatgagctcgtcgagggaaccgatggagggcagctgtttctgcaggtaggcaaacgcccagtctcggttgatgttggcaagcgacacaaacgcgtttcgcttacatgtggcgtcggtctcagcgtccaggaaggtggagatcagctcgtcgcagtcggggacaagggtctcggagatctctcgaatggaggcgatggcgaaaacggcgttctttcgcacgtaggagtgtcggtgctccatgttggaccgcacagagggaatcaaagactccagcagctcgggctccttgagcttgcacaggaatcgcagggtctctcctcgaatgtactcgttagggtgctgcaggtcgtttcggatggcgttacacacgagaatcatctcctgtttgagctttccatcgggctggagcttggggcagatctcccagtaaaagtgcagcagcttcttgagctgcttgttcttcgagggcatgacgaatcggatgatttgcatcagaagctggggcatggggtcgccgttgagcatggcgaccaggatttgccgcatggcatcgaccttgtcttcatcccgtcccttctcaagcaggttctggaagtctcggaccgagagcttctcagtcgagggctgtgttagtggtgtcttgtgaggtgttgggggcgtgtaatttttgaaagacacgtcgagaagagacttgtgggggccacaaaacacctcgggcggctttactcacctcgtagaccaacgtgtactgagctgaatcagacatggtagtggttaggttacacgtagtgtgtctcgtcaattgacttttgacatcgtggccataggcatgtgttgttaccctactttggggttcaatagagtgcgatccggccagttgcgtatttgatactcttagagagcgttagagaggtgtctagaaaacgggatggcaggcattttttattgctataaggtcacgttacaaaccgcgtcattctcaagtagaacctctactaatgacgtaaattctgctcaactacatacggtccgtgcacctcttcacatcttcccacatggcatatctgcagtgcgattgccgacattggaataagcccaataagccaagtgaagtaaatcgagtctcgcagttgacattatttcttacaatttcaacaacacacttagacactacgtactgttccctacagtgagacatctggtagtcttcccatattctatagagtttaatgtacgtattatgttattataaaaaaaaatacatattctactatgtactgtaattataaaatatataaatatatataatcatggaaagatggttatggtactcaacacacaatccatgctcctacagtaataggaatatcatattatcgatgacaatagcttgaacaagtgctacagactcgctacagtagcttccagagttggttgccatcagtgtgtttaccatttcatgttccagtgaggggtgatggaaaagatggagtttggggtcaaagatgtccagggcgtttcaacatagtttggaaagggatttgacccttgagatatagctacaatgtagatacatctcgaactctgcgtcaggaacaatgttcatcttcacagcatcccaaatcacctcttgctgcgtcacgtgccgacccctacttgtcgcttggctgacgtcacacatgcaaaagcctattatagtgctgggacatgcagtcgaaaatagcacctcctagactggttagacagacaacaactgtcacaaatccagcaccacaccaccacaatcacaatgtctcacggagctggagggtacatcaatggcgtggtttccgacaacaagaccccgtcgccgtcacagcctccagttcatgtccccaagcgaaagccggtccatcgaaaacctgtgggagtggactcgaattccaccactccaagtgccagcccgaaccctcagacaggctcacctctgctgggacctccaatcataccttatggagctgcgagtgccacgggcacgccgtctgctgctccggggacgcctcctgcagccgccaaaaagcaataccggtattcttctctgcttgatccagagccgacctctccgaaacccgcgacctcggaacgccgggccgtaagcgaggcccgaaaagtgcctccacttcaaacgacatctgctggcggattatctggagcaatcaacttttccaaacccgtgtcaccggcaagccaacatgcacaacagggcgtggggtttggtagagcacaggcctcacagtcgtctacggcccaaccaccgccgtcgctgccaccaaaggtccccgtaacatcaacccacaacccctactcggggactccggagctgaaacaggcgtcgtttggttatcaggccagtcagtttgcaagcccagctgccgctccttatgctactaacggaacgtcaccaaaacagcatgactcgaccagccgcaactacagcgcttcttctcgaccaccggtgcccaacacgtcttattcgacaccagtagcaccttcgacacctaagaataatggacctggcggaaatgtacctgggggaagtgcccatggaagcacgtccgcaagctcgcaacagagccctccctacccagtccccgcaaacacgtcgtcatacggatcagcatcgaatacgacacgacaaccctcggccgcctcgaccacaacctcttccaacaagtctaccctgccatacccagttcctactcctgctgcaacaaaacccacgccgcaaactcctcccgttcagagtgcgtacaagtttgatagccctcaagtcgaggtcaagcccgtggccaaaccagcagtgtctaaaccggctatgccacctattcccaaaactaccattaacacgtgcccccctgccatgcctcctgttcccaagaccaacattcaaaagccaatacccacacctgcaccagtagctcctgctgtcacaaaggcacctgtaccagcccctgcttctgcgcccactcctgctgctgcacccatctaccagccgtcacaccatctgcctcctcggtctccttccccggactcggactaccagcactcgcctccccgacgaacgctgcgagtcgtgaacgacttttcttcttctagtgacgaagatgaacccacaccggcaaaagctgctccccctgtgcctacggtcaccaagacccccgctggacctcgagagtaccctctgacgaaccgcatgtctcacctggagatcaatgatggcaaccatctggacccttttacaccagcagcgcctctgagaatccacaagaagagcaattcgtcgacttccaacccgtcgttcgactttgcaacccgtgagtcgttttacgccacgccttctggctctacagatgacatttcccaggagtacgtgaccaacgagtcgtaccttaatagtcagagaggaggcgttgataacaacaacagatctatgagttccatgtttaccggcaaccatagctacgacagcgggagcagtcatagcacacgtcccatgagcggagaggatctgctagcgggacatcatctgcaacctcagtacacacacgaatcagcgattgatccctttgatccttcgtttgatcctcacaacccagcatacgagcctagaacttcttacgagcatcccgaacctccttcaccccaaacccctgcgatccctgaaggggttgctttcgacggatctgcatttggaggaggagctgtcattggtggttctgttgctcccgttctcttggatccctcaattaatatcccagatcctacagagtatggtgcttttgatgtgggcgctccattggtaccttcagtcaccaatatgagtactggaaccgccacaagcatgccaggattacggggcgcaccgagcatcatctcgaccacttcccaggtgtctcaaaagggcagaatttccaactccgactatcctgctttgggtgtcgagtctcagtatgtccgtgcgttgagaaaacgaacagcctcagcatggtgtgaagtgccctccaaggtctggggtcttcccctgggtatctcggacaaggctggaaagaagttcaacaagaacatggacatgcgatatgcagctggcctcaagaggaccatggacattcgtcactcccacttgaagcccaggttgctggcttcggaggttgacgatgacgacggaaagagaagcagcagtcacacggacatgccatcgtccatgcatgctccctctatccattccatgtcgcgattcgataaccggtccatcatctctcacgacgatgatgttgacggtagaagcagtgtttctttggtttcagcacctcaagaaagcacgccacctcctgcagttccagcttcacgaggacgagccgcgtctgattcgtctcaggagagtgtccaggaggtacgacggattcacctatttgttgccaatcctgatagcgactgaagttgaagctaacgtaagcgcatgccctcggaagtgtatatattatatcaatgcattaattatcaacagtaaaatgcaatttatcctattgtgataacatgaaatactagaatgattcctctacgagtactcgcacttgtagacaccaatatcacgggtgggaattgtttaaaggatgatgcccaaggaaggctgcattggaaactgcccagagcccaattgatgaagtttaccaacgtttagagagaaaatattgtgtcttggcagtagcaattgtctgaccgttgatatgtactgcaacattgagttgagttctgaacttccaggagcgtgcctctactggaaggagctacaatcttgtatccagcttagcaaaactggtccaggctctggagatatgttcaatgttagatagttgtagtctaactaagacacacatagtgattaaaatagttagatggagaacagagttaccggagagccgagccggtactggcggtttcgaggacaaaaaccctgatatatcgggtcacttcgtctattttccactattgggtttggcaaggcttattggactcggaattacctccaaccacgtctctgctgcgctcccatgcactattcggactccgaccactcattttgccttcatactaatgcactgttctaacggtctcattacctactcgtacctgtaaagtcttagcttgactgtataaacgcgggatccttgaagcatactgtaactgttgtcgaatggcgttatatgttcgtgcccagacgaactgccttcgcttttaaaatgcttgtatgtttactctactgttgaggatggtatggtgactgtccaaacttcggggctccatgtagacgtgaagacgctgtgagtggattagtaaggatcatatgtagtagaaatacccttgagaaccctactgatgctgcccacattcagttgaactacagatgcaaagaattgtaaccaccaaggtacatactccttttttttcttctttccccatgcatgtcagctcaggactgaaagtcagatcaggaacaacgatggattagataaaacgaataggagaaaaaaacaaaataatgtttcaactctttttcatcaagtttatataatggagatggaactcctcgctcgtccccagaaccattgcagcgcgtcatatgaagtggatcggtacattcaagaactgcttggtcggtggaagccagcagcaaacccacgatgctgaagaacggggatccacatgcggatctaactctgtcaaagcagctcccactgagactacattgataaagaagatcttcaatcccaccatcgtccaacagaaagacacatgtgtcgataatgctctaggtggatcccaagagatggaacagatcacttctctctggaacaagacggatctttggatggcctgggcctccatgctactagtagccgtcgcggtggccctcgaagttcagacagtctcggtctactctacatttgcaacttccgactttgaccagatgtctctgctgtctgctctcagtgtggtcaaagcggtcatgtacattgccactcggccagtgatggccaagtttgccgatgtacttggtagattcgagtcgattctcatgtctgtggttctcttcaccattggcttcattatgttggccgcttcacccaacattggcacctactttgctgcccacatcttctacgtgtttggccaggtaggtatccagttcatggaacaagttttcgctgcagacacttccgatctaaaaaaccgaatgtttttcgtcatcctgcccaacatctgctacctcttcgtgccttggtgctcggctcccatcaccaacgctatcattaaacactccacctggcactggggctacggaatgtggtgcatcattgtccctgtcgtatccatcccagtcttgacgattatgttcagacataagatgaaagctcgcgctcttggaatgcagtgcggcaagtctgtccgcaacatgaaggagactcttcttcagttcgatttagtgggcctcattttgttcacagggggtctctgcttgctctttttggctgtcactttagtcaagtcctccaagtcctggacccaaccccatgttcttcccatgatcataatcggacccattcttctcctcctgttcccaatctgggaaaaaacgtaccccaaataccctttccttcctttctctgccatgaaagatcgaactctcatcactggatgtatctttgtgggcctctattctcttgccttctacatctactacccttactattacccctggctcctggtatgcaagggtctctcagtcactgctgctaccaacacctctgtgacttttacagtggcctccacagctgcttcaatcggtgctgcagctctcattcgttacaccaaacgaatcaaacctattattgtggctggtggctttgtgtacatcttgggactgggtctgacataccactaccgacagcccgaccactctcttgctcaattcattgctgcccaggccgtggaaggagttggatccggcatgctgcagtctcccactctggtattgattcagtctgtggtcaatcacaaccaagtggtatctgctacggccatcttctactcttcgatttcagtcggaacggtcattggagatgccatttcggggtccatgtatcgacagtcatatccgaagcaactgactgagtacgctccttttctcagcgaagcagacattcataagatggtcaatgatgttcgagcacctctcaaatacgcgtggggttctcctgaacgagtggccgtgattgaagcattcaaccatgtctaccgaaagatgctctacggtcctcttgtggttgcgggtgtgatgattctcatttctttcacgatgcccaatgttgatcttgatgagcttgagcagcgggtcaagggagttgttttcggcaagtcagataagcctgccgatggtgaaaagaaccccgtcagtaaccaatgtccttgtgacatcttgcccacggacaactcttcgcaagatggcgacttcgagaaatctgagtcggttgtgtcaaagaccattcataacgagcaaaagatctaaaaaagtagcaatgtgtatttatgtaacgaatttatgatgtctcttttttctcactcgtttttatgcaaatctcagttcaaactcacattatcagatccctaacttgagattacaaaccttaaatacggtcttcttcacaccttgaaggtagcgcatctctcatcatcatcactcacaacaacagccatgtcgactgacgattacgtgaaacataacatcgagttctttgagggcaaaaactcgggccctgaaaagaaattgacaagcgaaaactaccagaaaatcgcagaccagtgcgcacgtttgctgctggggttcgagtttggaactgcccattctaccactcgagacgacacctatgacacctcagtgagctcgctttggaagcatgatcctgctcccaaggtacttgactttgctggaggccttggacttgttgcccagcgaatttcctcttacaccagcgaggtggtgggcgtggatgtgtctcctaagatggtggagggcttcaacgaggctgttctgaaccagggcattacccccaaggaaatgagagctattgtggcagacatttcgaaaccggcagacttcgaaaaggtgaagcaggaggctcttggtggattcaacattgtcttctcctcgctctccttccaccatcttcctgatattgatggtaccctcgagaagctgtttgatctgaccaagtccggtggtacgatactgatcattgacttcatctctatttctggcgaaggcgcaggggaaatctttcctgatgccaagggacactccaatcactctcatggccatgatcacagtcatcaccatggtgatcctcacggccactctcatggcggcgagcactatcatgtggtcgcgcaccaccatggcttctctgaggaatctatcaccaagtctctggagactgcaggcttctcaaacgtctacctttctccccactatgtggctctcaaacgaaccactgatggtatcagcctggactcaaacggtcaccatcccgatcagaagctgcgactgagaatcatcggtgctcgaaagtagccggtgtgaggtgcgtttaatctgtatatatttcaacaactcaactaacgattttaatggcgtgttcatggcaaggcggcatatttttgctctgtcttgataatacagcagcaaaccgaggcagccggcagtcatgcatctactgtatgtacttgtaggacttgctgtttaggatacacctgcttgtatgtagcttgccattgatgattttgtgtgtctatagcttcaacaaaattattaattcaggctgcaacacgttctaataagtctttctctatcttggaggcgtggaacccttccttctaccggtacaagtagtgctgtctaccgctatatatcatcattaattgacttccgacatccacatgcaagatgcagctacagatgtcacataaggttcaagcaacctacaatatgacactacagtatgagaccactccaacgtcagacaatcatctctacaatatcattcagctctatccccagttatcctagcctttcgacactcgatcaaaatggtactgggattggactacctcaaaaacaaagtagtgggcaagggtgagtcgtacattctcggcttcatccctaacatcttccgatacatttctcttttgtggggatactttcaggtgcatgttctgaccactcttgccaaccagaagaagtggcgcattctagtggtacagaatgtagcacgggggagcgatccctctacaagttcatacgaagagaagttcttcactgtatggaataactggatcctcctgggcctctacaggctgatcaatggctccaccactctcttcaacacgactcagatcgacaaggccgccactgcggtcatctcagagtactactacaatttctctcctgaaaagacacgccccttcgccgagagcctctacattctcaattgtgagatcattctgggccgacgagttgacatgactgcatacttcaagaagtctgtgagcgacgactcgcagctcaaaggtggtttcattcccaacgaagactccaagaaccagcttctgaacgctctggtgctctatgaactgcctcgatacacaggagtgtcgttcgatgaccgacaggaagctctggagctgtctctcgccattattggagctctcaatgacaccaagattgaccttatcaagctctccgagacacctgtcacctgggctactgctagcaagaagttgatggatatccctgctactgctcaaaagatcccgcaccaggatgtggtgaagggtgctccttcttccaagggtgagatccagtgggagaactttggtttccaaggcaaagatccgtccactgactttcgaggttctggaatgttgggcttggaggcttttcgacacttttacttgtttgatcccgctgaatctaccaagctgatgacacaatccggggcaacagaccctggtgagacctggtaccctcctgccctcatcagcatcaatgttgtgtcccatctgcgagacatgctcgttgccggacagctggaccggggcttcattctcaacattaatggcgagctcttgaagcgaattggaaccctggcgttccacgagaatgacaagaagaagcaggactactttttcgagatcagaggcgagcttgatcgggagttcaaggaggttttctacagactacacgagcatcttgtctacaagttccatctcttctggaagcatggtgtgcaggagaagaagattcagagcgttctgcagactgacaaccacctgaagatcttcctggagaaatacgacgcaaacctgcgacggggagactggaaataaaacatgagagacacacacgtgcaacacacaaacattagttaattgattcatctgatctgcaaaaacatgttggtgatggttaagagtcacataacaagcagggtccatgcactcgctttcttacatagcaccatagaatacggtgttgtcggcattatcaagacagaatttaatttggtgatgttatcacatgagccggggggcatagggtgggcactcgtactctatgcgttattggttgcagacccataatctcaagggcgttccagaacatacactatgcgaccgcagggaccctcgatatggacgatgaatagtatggcaacataaaccagaaactattatatagagatgatgggggcgacatttcggtaattacgttcatccaccttcgatcatgtccactagtgctatgaccgacgattatcccatggctgaggtctccattactgaggagaccaagatgcctgagcctgccaagaaatcgcagcttcttgtcattctgctctgtctctttgccgccatgggcggttttgtctttggctatgacactggtaccatttctggcttcatcaacatggaccctttcctagagagctttggagaagccgatgagtctggcgttttctttctatcccgaatccgagctgggctcattgttggactcttttccattggtgctttccttggcacccttcttggtggcttccttgctgacaaggttggtcgaaagaagggaattgtctatgtcgccatggtctacattgttggtatgcttatccagatcacagccttcacagcctggtaccagattgccattggtcgtgtcatcggtggtgttggtattggtgcactctctgtgctggtccccatgttccagtcagagactgctccccagaatcttcgaggcgctcttgtctcttctttccagctgtttattactctcggcatcttcattggatttagtgtttgctacgctaccaagtcgcggctcgataccggtgcctaccgaatccccatgggtctttgcttcgcctgggcttttatccttctcattggcatgtgcttcatgccagagtcccctcgattcctggtttcaattggccgcattgaggaggcccgaaaggctatggccatgacaaaccaggttcctctccacgacgctgtcattgatgaggaactcaaggctattgagaactctgtcattagggaaaagagtgctggtaaggccacatggaaagaacttttcactggcgagccccgaatgggctaccggcttacccttggtattctcgtccaggttctccagcagctctgtggtgccaactactttttctattacggaacttctatcttcaaggccattggaatgtcggattctttcgctacttcgatgatctttggcggaatcaacctcctgtctacctttggaggtctctacattgttgatcgattcggtcgacgaaagtgccttcttggtggagccatggtcatgtttgtctgtttcctcgtctattctactgtcgggttcgctgctctttatcccaacggtgataccacccttcccgccagaaaggctgttggtgatgtcatgattctgttcacctgtatcttcatcgccgctttcgcctctacgtgggcccctattgccttcgtcgttgtttctgagaccttccctctcagaatgcgatcaaagggaatggctgttgctactggaggaaactggatgatcaacttcctcgtttctttcctgactcccttcatcaccagttccattgggttcaagtacggttatgtcttcactgcttgcattggtttcgccattatctttgtcttcttcttcatccctgagaccaagggtctgtcccttgaggatgttgacgagctgtacgcttcaggtgtcagtgctcgaaactcccccaactgggttccttcttccaagaagcaggaagtcaacgaacctaagaacagtatgaccgacttctccgagtcctcttagactacagaattatttatagagaacaagaataaattttaagactacgagaagctactgtacagcacttttttattatttttttttattttatcaagttagcattcatctatatgttatgttttggtacaacctctgtaacttgcaagagtgctctctacatcatcctcttgccaatctccgactcccaagcagctgctcgttcgaagccgttgctgctatattgatagtccataaaggcgttcatgatgccttcttccgaagttgcgacaaagggaccatgttggacaatcttctggtcgagaatctgggcaccaatgatgatgattcgagagtcaggggcaggagtgaaatcaatggtgtcacccttgatagagagtatggcgacattgtgggcgttgaccactttaccatcaacgatagcagaacccttcattacataaagaagagagttgaagcctgcaagcatagtctggctcacctgcttgccgttgtagttggcttcggtgaagtaatccaggtaccagacaggagtgtatgcgagatccttgacagagtcgacgcccatggcctggccagagatgactttgacagttagatccttattttcagagtgagcctcaggaatttcctcagccttcaaatcccgatatcgaggctcacagtccttgaggtgttggggaaggtcaacccaaagctggataccctctacaacctgtgtctcgccgttgggtcctgcagtgggcatctcggcatgaacaatacctcttccagctgtcataaactgaagatcaccggcactcagagtacccttgcttccagtgaagtcttcatgatcaacagaccctttaatgacgtaagtgatggtctcctggccccggtggggatggtcaggaaatccggcagtcgagggcactttgaaatggtcaaacatgatgaagggattgaggtttcgtagctcgtgggtaccgatagctcgtctgactcgggcaccaactccctcagactgttcgggggcagtgaagagcttatcgatggtctttgccaaggggttggtagtggtggtagtagtagacatgtgtctgtgtttgtgtttgtgctatgttgcttctttattgaagataatattcaacactgcgtaattgttggcccttttatatttaacggcaaagagtgacgcgctttctagaacataagtagtaatttgttaccaagcatacatcgcatacattatgcaggctaatagagtgttgtacatcagggatgcaacataatacagatgtcaggtatgacccctctaaaataactcgtattagaatgccatcacatagagctaaatgagacctgatggagtcgcaaattgaactcagaagcgaaaaaagagattcaccagccgtacgattttgttaactgtcacaaaactcgttgtttgaagtctcgggtatgagcttcgtttcctctctacaaacacacagccgtaacgtacgttaactacagaacgtcatacaagagtcatatattaacatcatttacttgaatcaacacaatatcgatcgaaacatcccatgcaaaagtctgggatggtcttgttggctccctgataagcccggagaatagtggcacaaccaacgcacttattccagtcggggtcgacagtggagttctgtctggtcatcagattgtagccgttggtaatgtagccggcaacatcctcggtggaaaactcaacctggaaagtactatcaccggtccagtaagattggtagctgtttgggatatacacaatgagaggagggtacttgtcgacaccaacagtaacgttgacaaaggggtcggtggaaacatttgtaggaggcatgactggaatggcaccaataggggtagtgtggtcataaggatagtcagcgtcatagtcacgaccatcttcgatgataggccggggtcgtgagggccggggtcgagggcgaggtcgagggcgaattataggtcccgtatcattagtagtgccgttggaaacaggaatctgtctggctctccagtgagccctggaagccatactaacatttgaaaaagtggagttaggatcaaaggtagagttagggaaatcgaacgggggaggaggaggatatacaggaatagtcatattgggctcggcaggacggtctcgtcgatagttatagctgtaggctctccccttgggtggtaccgagtaagacgagtttatgaaacatccaaggaaaacaggttcattgccaaactctgcagccagctggggaaacgatatgccagccgcctgctcagaatcctccgaaaggtatctctcttgtgacatacgcagcgcagttccatctgggaagttgtcctcagtgttcgaagacgcatcaatggcgaagatgacatcaacattacgctgttcctgaagtaggggctcgaagggaaccagctggccatcctcaccaccatcagccaggaaaagatgtttggactcagaaaacttatcagtggtggcgttagagtcaaacccaaggaaggggttgggtgagaagatggcatagtcggcgtcccgccaagtaagatcagtttcagggacagtgctgttctctgtagaaaagaattcaccccagaaagaggtattgaaattctcaagggcatcaatgataccagtaaagagctctcgaatgtagtcctgatcgatacccgaattctcgaaaggatcattgaagacagaggaagaagtgccggcaaggaaaccagcattatcatatcccaagacacaaacgggctcagttgagggaacaggctcaagggtaacattgttgacgggggtcccattatagagggatgaaccaaggtatcgagtgtcagagaaggcgtttaaagaagggttccaagatccaaactcgaagggagtcatttcgaagagagtcgaccaaagaggagagatcatgtaggtactgttagactcggagggctctcgaccaatcgcaaccatgatagggaaaggcacagatgcgttcatgaactgaggtgtgatttgaacatcggaccaggtagtaccctgtcctcctcgagaatcaggaagcagctgacgggcgagtgctcgaccccagtaatcagtgatagtggtcacaaaaccagcactggatttcaggtcgacctcttccttgatcatcaggaagtagtacagggtctgcttgatctcattctccaggtggtaataagtatacagagggtcaaggtacttcaggaactctgaatagtctaggtcacagaggaagtcaggagaaacgtactccaagagcttttcgagatcagactgacgtcttctctggttaaagaagtcacccattgaaggtttcgaaggaatgtgtttgtcaagagcctttcgggcatcagacaacccaggttttattcgagagatccccttgtcgacgttatcatatattcctgtcttgggtctatttctgagtcgttgggcgagatcgaagtggggccgttgagaattcttgagccgatcagcatagccagtcttgggtcgattcttccaggtgtcggaaacgccagtactgggcctgtttcgcagccgatcagagagtccagtactgggacggtggtgtagtctgtcagagattccagtcttcggtctgtttctcagacggtcagcaaaaccagtgctaggacgagtacgccgaccattggaaatgctctcaccgattggaggcatgtttcgaagacgctcagcgataccagagttaggtcgtttggccaacatgtcgttgaggttaatgtttttgacaacctcagctccaccggtcgaaggtcgtcgattccagtggtgcttgattgagtcggaaacgatgttccgaggagctagattgacgagattcttcagtcgagagctcagacgatctgtcaggccagatccaatgacaagagaactgttgtcactctcggttccgttgttatcaataataccagggttgggaacggggttgtcaagctggacgtccttcattcgttctccaccccagaatgagttctcgagactccagaggttaggagcagcctgaaggtcaggaacagtgaagttgtcgttcagaaagagagaggtcaacaaccaacttccactggacaagcccaccaagtaggacattgcttggaagagaccacccagcgcgccaaggtcaagagacccgtttacacgggcgtccatggcagcaacgacacctgctcctgtcaacatggatcgataaccacctccagagaaggcagttcccatcacgacaggggggacttcgtccaagaaggagacgttgaagtcgggaatgtcgagacgttccataaacttgacatgttcttgctgagtctgcagccatcgccggtccatgtagtctttctctttgggattgagggtatcgttggcctctcgaaccagtacggttgggggacaatcaacatgtttgggctcatatgtgccgccaggggaagcggcaagagtggccaccaaatgcaggaataagggcgtaaactgcatcgtgttttacgctacaggaaggtccaccagtcggtcacgccatgaagctccatgatatatacattgtgtgatatggcacagttgagtggtgtctggagtgcgtgtccgttagtatatgggtttctccgaagttgcaatatgccatgtcataaatgcccatcacgggtagctgccagtagttgagttcgcagatgcactcgctgccagcgccaccataacttcgtggaagtacgtaccacatcgggtttgcataaagttaactgacaacagcacgatccataatcccatactcgccacacaaacacgatcacagccacgtgcacagacattgacatcaagatgccaaacgtgtataacgagtgagttcattgagccatgctgcggcgacgcacacgaacaagccactaacgcagattcctgaaacaggttccaccggctaccaagctcctgaccatcaccactgtgtcagtatttattctgtcacgactgggattcctcagcccatacttcccctacaatcaatggagcacattgtttcagacctgggagctctggcgtcccttcacagccctcatcgctatacagggcagtgctattcccgccttctacacggcgtaccaaatgtacagctactccaatgacctcgaggccaaccactacggagggatcacagccaagtacgcgtggtggctcacctttatctctctattcatctggatcggagactatctgctcatcaactcgcccttctacacccgtgccttcatgatggcactcacctatgcttgggtccaggatcacaagtataaccaggtgtcgttctactttgtcagcttctcggccaagttcctgctccctgtcaaccttttcatctccctgctcgacgacccttccgatctctacccttgcattcttggcattgtggctgcccacactttctactttctcgacaccatctacccctccgtgtaccctacttacggcaagttccgaattgtcgaacccccccagttctactacactcttctggggactgaatcgtcggcatacacttccaacatgggcaccggctcgcaggctcctaccaaccctgctggtgcttccaatgcctgggggttgggcggtggccctgtcggcggagccgctgcagatggtgctactactactggtgcttctgtcagaagtgagggctccggtagtttctctggtcgtggccagcgacttggtacataaactgtagacattttaatgattatatgttagaaaattattcgtgctcggcaaactcgggtcgcaagtcgcttcgagtaggtcgcactagagggtgtagttgggcgaggtatgtgattgcccacattaggtacatcatggccatggcaaggatcaacgatgatctccagacgctgttgttagtactgttcccttgataagtaatgtgaactgttccattatcatgagcagttcaaacaccatctgctgccaaatgtcgtacaagtagagtaattggccctgtccatatgcctcagttcgtggtagtgtgcaacatgtgatcatgcacatgtctcataccagcacaagctgaccagcagccatcacgacgtcgttcaagagacgtggcaaatccagcaagccattttcgctcaagcctccatcacatccgcaaccttccatcatactcacgtctgattgtcgcccttaggtgcgaacacccaggcaccaaaacaaagacccacgacaagtgccaatacaatgataacagtccagctgcgttagttgtcgtccataaatagtcccttttactttgacaagtcttcctcttcaataaccgatttcactcaccctcccatgttgtgtgatgttgtcgatgagattgatgatggtggctgaagctaatttggactcttacatgctgtacatactggagtacaatagttgtggttagagtaagggactcgtcaagggttttagacaaaataattgtcagtgaaaaacagcaaataaggaagataaaaatattgaaacagaggaacaaaaaaaatgaggaaacaacaactaacatattccctcagccatgatcacccacacccacccctttacttgttaccagcagggttagggccgtactcaccacccgccagccattatctgcatatcaaatgctactgtccacctaaccaagacacccaggttacaagagacattgcattgccatggcgcttccgccggcgctcacccagtggttacggaacgtgcttcttccggtgagtatcttacgacagctcctaatgcccccttcaacgcgcaagatcaattgttttctaacagcaggaatacccccatttggaccgcacatacaacgacactcttgacgctctcacacgctacccgacacttcggcctcgaaccagtgtttacagtaagtatcttgaggatttggacagtactgattggggataaacaactaacccagccgatgagtatggcaaaccagcactactgttatgtttgcatggaacagtgccttcagtgattgctggagacacatacaagatccccgtggaggtctgggtgccacatcggtatcccgacgaaggaccttttgcatacgtcagaccgaccagcaccatgatgctgagcccgggaaactacgtggacaacaacggacggtgctatcacccctacatcagcgaatggggttcggatccccagaatacgaacctggctaccttcctgagggtgctgtcagacattttcagtaaggaacctcctgtttacagtcgtcctacacctgaatacggacctccacctacctatccctctcagaacgaccagcaacagacacaccagatgcagcgtcctccgcctttggccccacaatcgggtatgccaatccagcctgttcaaactggccagcatgctgtgccacctgtgaccaaccacacaggtcaacatattcagcaacagcccatgcgtacgggtcctgtagatctgggtggctcttcgactcatgcttccgaagcagtgcctccccttccgcccaagccaccgcagcaatggaaccagggcgccgtacctcagccaccggcccagtatgctcagtatgctcagcatgctcagcaccctctccaggccagccaccaccctcaggcacgcggcggtcctctttctcagcagttcactcctcaccacagatcccgtgcttcccgcacagatatcatggacatggacaccgcaaagtcttctgacgaaccggctccacctaaaccccctaaccctgagcgaatgaaggccttagatgacctacactctcagctgaagaaagaagcggatgccatccaggcaaacgtgcaagcagatgatgcccagattgaaggtctctggatgaaactcagctctctggaagcaggcgtgtcttcggaagtactgctgctcagacaactggaagcgcaggcagacaaaaacaacaagatcctgtcagacaaaatggaccaggctcgtcgagtcattacacaggccagagcctgcgagatcccagatatcgactcggctgtttgtgcagagaatgtggtcttcaaccaactgtacgatctgactgcccaggaacaagccattgacgacactatttatgctctcagtcttgctcttgaccgagaaaagatcaccgttgagccgttcatgaagcatgttagaaacctggcccgcgagaagttcatcaaggttgccacgattgataaaatcgccgttggcgctggcctcaagtagatctgcatccactagataacgaaaggtaatgacttatgtatagtgtactaattgtactagatgagttttggaaacgtcactgtgaatttatctgagaagtagagacctatatcaccagagtcaccatttcaggtgtccttaaagtcgatcgtacaacctgtcttgagccttccatttaacagagacaaacacaagagaaatataaagcaatttagaaagatatgatccctttacctgtgtttcttctatcaatatccggtctgtatcctcgaaaatgtttccttcaccaagtcacgaaactcgcgcacgcaaaacgacgggacaaaatgacgccatacagctttgtccaattacaaatggactagaaagcattgaagaatcaatataacaccatttactacaatgtgactatcttagattcactgtagaaccattttttttattctaatgatttttttcaaaaaataatattttggatacagtacccctagttttttgtttaaaaataacaatgggcgtctggtgtagttggttatcacatgcgcttagcatgcgcgaggtccccggttcgattccggtgtcgtccatacttttttacatttgtactacggacaatcacaacttgttaattttttcacgtcgactattacgcgtaagcgcagtttcgtagattggtcggatattatttttgttgcaccgtcttcgtatcgtacatactgtaccagcagcttcgtcattattgtgtgtttgttttgatcacagcagttccaacgcgtgcccccaagtatcgatctattgtacgcgacctgtcacattataaaaaattaatattattccattaccaatacatccatataaatagccgcattaaaaaacgtggtacaaaaaaaggtatcaagtccggcttgcggacgcgtgtgtgagtgtcaagaaacaaatgtcattaggacgaacagggagaagaggatctcattattgaacgtcggctgaggtgatcataatactgctgtttgcaggtgcctttttcttgagcttgccaaatacacgcttcattcctcctgttcccgtggatccgctgagaagagcttgctgtccacgcaatctgtcgtcgtcgtaatttgactgctggtatgtagacacatcgtccacggtagggtttgaattgttgttggttccggtagccagctccttctgccagccataaagaacctcgtctcgatcacgcatggctgctggcgacagagtcacgtgtagagtcatctgtcgtgctcccaatccgatatcattgggcgacgttggaatgccaacggggaagccgaattcaacaatctcatcaaaggttgtagcgttttctgcattttccgcaggagcgcatagcattcgcagcttgtcgcgtgcctcctgttcccgccagaagactgagctcttgactgttcccatgggcaagatgggagctgcgtgaccctttgtttttttactgatggagttgatcaaagtgctggagaagcctgtgggagacgtagtctgttgttctccgggagaagagggaccttgggaaggtggtgagagtcgtgaatatgaggttgtgacctggggaggcggttgtttccagcgccgttcgcttcggtctgtatgttctgctagcgacttggggaagtttcggggcaggtttggaagttgagacgagtcagattgcgtgtctccaaagtgaagaggctcgactggtcgaaggtcctgacgcgactcttggtagtattgttgttgttgttgttgttgttgttgttgttgttgttgttgttgttgttgctgttgctgttgctgttgctgatgacgttggtcgtacatgcgtcgcgaagagaccgatcctgaagaattggagtctctgttgatgtgtgcctgcgaacgtcgtttgctgagcgcgacgttggggtaagttgctgttgcggtggtggcggtgtttccagttcctgaggggctcaagtctagcgcctcgatgggcggcatttcaggcaccggcggaatgtcgtctgacgggccttggttgcgcctggacgggttagtatgtttgtacgagagatactggtagttggacgggtacacgaaatcatgtgtgcttgtgggtgtcgtgggtgtcgtggacgcagaatcagacgaccgagagtcggtagatggagacttctgggccacctgataaagagggtcttggtagaggttcgagtagtacatggtgtggttttgttgtgactgtcgtagcgtcgtgcaagttgactaactgaccctggatgaagaggttgcaacgtgacagggagacggagaagagcccgaggcagctggagtggaaattatcgaaatgtagtatactcacctgcgttgagagttcattataacaagttatccttgtgttgttagtttgactcctgggttgcgtttcgctaggcttggcttgcgtgtgcgtcttgcgtggggcgtttgcttttgtgctttttgtccggctggcggctctggggactcttgaagaagcagcgtggtagggcttaggggaaatactctgaaaagaggattttgggcgctctgagagtggagtgtggtaaacgacgcatgtcttagacgcgcgtcctgtttgagccgaactataattgatggatgtggtaagtaagggggtctgtctatcactccttgtgtcaggaccagatgggtctaaatcgagtgtgctgttgcccctctggggagggtcgagagttatggggtttgtatgggcctagaggacccgcctggaccacccaagattgctcactttcggatgacgttttgtagcgacccctcaaaatatagcgttaggcaacactggtccccctaataactgcacatcacagatgcacccaaatggcaggccggagattagatttttacaaaagcagaaacgacaaagcgaagtgattttcactgcaaaaccaaacaatcttgtcgtcatcaggtgtgcatggtagagagttaatactggcaatattatctgttgcggggcccgtaacacaaatgcgctgggcagacaatacagccgtggacgccatcagcgttgcgcaggcgttctttcgaggtcgccactgtaggattaaacaccgccgaagcgagccacaagaggcggttagctacaaatttgtgaatagtcttcaagggagagcatggtcggttaacctcaaactatagacggggtcaatacgaagagcgatctgctgtggttcgtccaaattgtactacttacgactgtgagtgtgagaaataaccattggcacactacaaataccgtaccgacactactacccttggaatgtgctatctgtagcgcatctgctatcatgtggagcacagctttttagcacctttggattttccatctcgaaccatgtctacaagtagttaaagaacaacgtcgaaaaagagtgtctgctccctcggccagaaacgccttgtgccactttgcacgtcggtgctgctgcagacttcccctcctgggaccatccctgaatgtaatagtgagcggcatacaagcgccattattcgtatatccccaccagcggcctattataactggattcattaggtgtgcccgtgcttcccaccgacccgtacatatcgtacattacctcgagtttatttgctgtagccccctgtatgggttgataggttgtatctaagagtagcaagtgccctgaattacacgctccgtgtgcaagggtaagaacggaaagtaccagtttccacttcatcgctacccacgccgctagctaccagggtttaccgctgggcttcaccctcgctttcccacagtgcggacctcccattgtatgaccactgtttgcccgactgcatttgatctactgtctttgcacacttctcacattagcattcagcataagaaattcgtgggtccgaaaagcagcagtcttccgaagatcatacgttccactacagtaagtacaactacacacacacacacattgtacgctctattccaaaaatacaaccggtaattagttggtagctacacaccatacacatgcacctccaccccaggccagcaatgcagagacaatgcaaagcgtgccttgggcccgaacggaagccctattgtcttattctacccgtgcccccgcctaaaagccttcctttggtctcttcttcgcctgtcatcatgtttgtttgtcttggttaacggccaacctaatccgaataggggcaaccagacaaggtccacggtgctgtgcactgtgcagggcgcagactccatacagcagcccctgactattgagtttgcctgctctgatggaggcttctggacgaggaaccgagccaccaggactacaagtagtacagtagaaaatgctgtacgtccgtatgccaaagagctagactatatgtacagcatccacgtgggagccatatatgtgcccgtgcacgagacgctgtttatcacgtgtggttttaagacatcccacgtcgtcatacatccatgtttgaaattccttgcaactcatgtcacagagaacaaggaaatcggtccattccacactcgtcggttcacacaagcgagcacgaggtacaggacaagtctgtggatggattctgtaatttcatgactgacttttttgaaaaggtggagtatatatgatgctgactacgtctacgtcagtaattgatcgcacatgtagcgatacagccaggtcattgtacagtaagtctctataccagtcgctctacaccacctgttatcactttacagtggctaatgcatcctctcctcatacagcaacatcaacaaccgattgcaaaagaaaagtgcccctgagtggtagcaataatatttgcccgcaaaacgccttatcacagtatttgaaaagggtgtaatataataacggcaattatatacaagtaaaaaaactagattaggtttgtacagctaaaaatatgtacttgtacgagagctggacgcacacactacattgtagctcgccagtgaacttcaagatcaatcgacatgatccagtcggcgcaacggtgcaagtacagtacagtacttgtacttatacttgaacttattggtatatatacatgtcgtgcattggtccacaggtgcaatatcgagccaaaatatctctctcctgcaagatgaagaacatctcttctggggatctgctctatgtcgaggtgtagcccagctgatgacatgtgaaatcttctttattttagcacttatttgtcaccattacttgtatttattactgatatatcggataataaaacccttgcgacccctctatggaacatagacttgcctgttccggaagtaatgaagatgaatacaccctctgaagacccctcaagaccccttaattcacctcattgtaccagtaatcagactaagactaacagtacaagcaccaatagtatataccaatggttaaccaataactcaatatgctaatctatatacagtacattcaaataaggaaaaaaaagatacacccagtttgtattgtcttttcttgaagtccctggtggatcctaaacaagccccttattcccggttatgcagcctctctccagtcgtgtacaacttgtctcgaatctgggcctcgtagagctctaggaattggaacacctgaccccacacgacggggataatggagagagccaggatcacggggtaaatggcaatgtggataaaatgtgtctggaagaatccgtcaagcacaaggccaatcatggcgggaagagccaccaccagcagagataatgccgacgaggtgatcaccagcttggaaagagccttgagattgcaggttcggattccgttctggaaggtttgcgtgaatagagggccaagtacaggaacatgcagggaaggagcatatttcgctgcgaccagaaccatgaagcccatagaaatggctcgggcgacggtagatgtgtcggaatctatgaagatgtccacgactcgcagaacatacatctcgcaagcagccgatgtggcaatcaacagagcaataccagagaggaagacgagcacgaatcgcgaagcgatagcccccgacttggtggaggcgaccaggtagaaaccagctgcaattggagcaccgatggagaaggcctcaatgtcggaaaactcgctccagagattgttgagaattacggagtagaggaatcgtccagtgagaataggggcagctacaagaccagtgatacagagagcaccgcagatccatatggtgcacagaagtgccaaaattctgggttggaaccgggggggagtatagacaaccacataatccgaagaagtcaacggagggacctcttccccattctcagttgcgcctgtggtctcagttgcagtgtctgtgttactggcaatggagccggagtcggcatcagcctcagcgttcgtctcggttctggggatcttctccggaataatgggaacgtcatcctttgtcacttccacaaagaagttcttagattttctcagggaaacagaatccgaacaaggagcccgcacaaaggagcccttgggatcctgctcactgttctggtcgtcgttgaagatgaaagacgagagggagagcactgcgcaagttcgcttcagaatttgagtccaagtgtagtttgcaacctgctttccatcgatttgggaagacagccaaagagacagacacacgtgaagacccacgtggaagaagggcttgctgagccagaaatcccctagagcaacatcaagcgacaaaggcagcaggcctgccttgtcagaaagcaacttttggtatgcaaaggtgacaattccaatgcacaatccaatgaagacagcgtacattcctccagaaatgatgatacgcttgaactggaagtacattgacttttccagcacctcttggaccggctggtaagaaggatcattggggtttcgcacaaagtacaaaacaccgggtcgcatctgacctcggcacatggacacaaacatggcgaactggatcatgtagaaggtaccaatgacccagtggagaacaatgtttgtaagaggaaacatgctaaactgagccagtcgctcccaccagagatcgctgaagttaccaaatagaggcagaatggacacatgcagaagcaggccacaacagaaggggaataccaacaactcaacgccaaacatggtaatgacctttactatggcctccagaagcttgagaagctgcttggcgtccacagagagtttaggcttggagatcttcatgtacaggtagaccagcgaggcaacaaaggtgtatccaacaagaacctcaaaggcatgtgctccgaaagttgtgggattgtagaattttgtgttgtaagaagtaagctcgtcggatatggggaaccaagtagagccaaatactcctcgcaggaacttcatgattatgccctggatggcatcaatgcaatagtttatcgtatcgacattcttctcgatagtaaacatggtagcgcggccaatagtgtagggagaaaagagcagaatgactgtgaatccaaagtaaagagtgtatgcagtgaatgtagcttgccacaacgccttgaggggacctgtgaagcccaaaaatgccatcagagtattgtcttccgcggcagcatctaatgcagccagctcgtcgtcatcacgccgagcagcccgcgcctgctgttctctctgatcctctagtcggttaatctgatcctgcattcgtcgcatctcttccagcacctgtcggtcgtgctggacgttgtttcgttgatcctgctggaactggttgagggcgtcaatgacattttccacgtcttcgttggcgccttctcctccaatgcgtcgcatcacgtcaactacggcctgagcgtgtctctgcttgatatcctcctcctggatacggtcgagctcctgtcggaaggcgaagcagttgagtacccactcacgcacaaagaaagggacaatcacggttaggagatatgcactggtgatgacaagaccctcgaatgtcatgacaaagagcccactgtaaagacctccatctgtgaagaagaactggggcaacagtgctctaccgagggggaaggtgctgatattgtccactagcgattcctcgatgaagagctggtgcgtgaacttgaagattttgaaaaagaagccacttgtgatgatggggaaaagaatcaaccacttgcaagccaccagaaaatatcgcaaccacgttttcgtgctcttgagcacggatatcgataattggtgtgagaagagacccagaggaatgtccctgggcatgtctggtgagtatattttggtgaagaggaacttcgtgttgcatagctcgcacacctgacccttcttcgatgtggtcagccactcctgtaagcaaccctgatggacgtatttgatacttccggaacatttgcacgggtagaagagtggctcctctggtgtttcctcacacctgcagatacgacacgtttccatttcgggctgtgatgttgttttctgtcggaagatgcggttgtgttgctggatatgtgtcttgtgcacagactgtcggggttgtagccactctgtgctgttaaataactgatggacgatcggctctggatgactgttgaatgtgtagagcgtgtagcagaaagtatgggggtctgttgtacgtcagctggcccgaacaagcgtgatattgttgtgtaagtgtaagcgtaaatgtgctaagttcgaacgcatgaaaaagtgtgactgcttagtaagagagtttatttaggtgtcaacgtgatccagcgagagaagataattcccttatgggtggcaccgataagtatctgatcaaatccatgtcctgctaccgacagtggtaggggattattctgcactttcaaccgttgcagtgtcttttcttctggtctgttgagttttctgtcatgtgtatgatttcaagtacaagcgattcattcattgatgtttcaccgcacaagttttgacatgccatttgtgtgtttcatcgtattagcacctgatattattggtggtttaaatggaacccatactttcacgagtactcgtaccggtacaagtactacaagtacgagtacaagcagttgaaatcgttacaagtactcctctctcaccttctgattgcaaaaacacgattgacattcttttatgttttgtttatggaagctcgatgttggatttccctaattgtactgtatatgaagattatattgcttgcatattgctctgaaatgcgagtgggatcgtaaaacagaaacaagtagaagtaccaacttatcttcaaatgcgctcagttttccgtatacagcaatattccagggagtatgtgctaatctcacgttccaagcctccaaaagagaagtacatactggtaattttaatctcacccttgctcagttcggtgagacatcaacagtattacaagttacagatacttgtatttgatttaacgtggaaacaagagtcgaaatgacgtgcaaaacaagacagacattctccctcttgtaactcgtttttctacagacgctctatatcttcttcttgctctccgtttagctttatggatccgtatctatcggaactttatctacatcaacaacagacacaacccttctcttcatccacacaaacacgatgatcagacgccaccctaccgccatcaccgtgaccacggccgacattctcgagtacgacgaccagaagcatcttgaggaaatgacaaaacaccaacagaaggctcccgagaacccaaagttcgagcctccaaagccccagaaggaccagcgatccaaggaggagcgtctgggaatcaggaactaggcggaagaaacgaaactgagtcgggactacaagtcacagaacaaccacaaaacagatacagtggctatcacgctactattacgtcaatactatttatgaatgaaaggagggacggcggcagcggtgttttatgtgtgaccctcacagttggactgtaaccgcacaaacacagctttgcacgagtcacattaactcgtagatctccctataccgatagctctacgatatcacacagcggttcaggtgctcatacattttgcatctcattgtaagtagcacttcctgattacctaatagaggttagggtaaactctaatccgcactctgtatgcaagtgaatagacaactccaaattatccacacgctctctctagaagacccccacgcaatagcaccggtagtctcgataccccgccggatcatccaagaatgccaagcacagaacctagacggtcgcgacgaacgcgtgttgaaagaagtgagtgtgtgaaagaagtggattgtggtgttttggacgtccacttgaacgcgtcaaatctcagacatgatatgaggatacgtgattgtggttgtgcaatcaaccaggaaagaagggcacacacatctggagttgtgtccgtttcgatttctgttcgatttacgcgtatcctgcagaaatcgcgttcctcacgtccatacaagtgattcgcgtagaacgcgtcttctgtgcctcatggtactaactccagcataccacgacgacgcctctgattcagacgagcctgtagtccagacacgacgaaccaaacgacacaaaaccaacagcggaaacggcaacgctaacaccaaccagctaatcgatcttccagatgaggctgatgcgactccaaattatctgtacgatgctctatgcgatagcgagtcttctttgacggagctggcacgtggttggatcgaaagctacgaggaaaactcgacttttgccatccgggactttgtcaacatgattctacgtctagccggatgccatgacgtgattgagacccacgacattgaagagggagactcagcagcagccaccgtggcccagctgcaggaccacgttcgaaacaagtcggcggcgcagtaccccctggttaacaagaaaccgccgcacaaatttctgcgggaccatctcaacgagtttctgcgtcacctggtcacctttgccagcgacaaggacctgctctacgacgacgagagtgccgagggcaacgtcatcgacaacctgctcatctgggtgtctgcactgtcgtcttcaaagctgcggcctttccgtcatacggccactgtagtgtctctcatgtttctgacgaacctgtgcaacgtgtacagctctgttctggagctcaaggaggacaatgagaaggtgctgacgaatgcggcatcaggcaagggccgtgcttccaaaggaagaagcgatgaacgagtcagcgcagccaaggacactatcgagacatgctccaacaagattggcaagctggccaacttcatgaacgacatttttgaaacttgctttgtaaaccgataccgagacgtggacgcacgaatccgaagtgagtgtgttctgcagctcaacaactggatcgaaaacttgccgtctgttttctttgaagaccagtatcttcgatactttggctggctgctgtttgataccgatcccggtgtacgagagtcggtggtcaacggtctggccaatctttttgataccctcaacacttcaggtttcttgcattttaccgaacgattcagatctcgtctggtagagatggctcagagcgacagcgatctggatgtgcgggctggagtgattgagttcctcgtgcttctgcagcaggccgggttccttgaacaggacaatgtagacaaggtgataatgctgctgctggatgccaatgacgtggtcagagagcaggtggttgatttcatcgtggactactgcaacgagcagagtgaagacgaaatcaaaaacatgggcaggaaggtcaaggctgtcaagagtgtcgacgccaaatgggtcacctacaagagtgtcgtgtctgtggtaagcagtgctatcgccttgcctagggacaacgaatcggaagagaacgaagatgatgatgagagctcaaatgcaaacattgaagtcggagccaccatcgccgaggaccttacgcaacattacgagtccgaagatgttaagaaactgctttcatacctgctgtttgatccttcttcgttatccaaggacaagtttgaggagcagctgagcaccattctgcagctctctgccagccaacagacgttcttgttgcaactaatctctgcttgtgtggagggtgttttcaaggaggcgaagggctccagaaaggctcaagattcgaacgatacagagactatctcctctctgatcatcgacgagactcctgctctgttggacaagttttcgtcttcgtctgacatgctgactttgatcctgcagttgcattccaaagtcgacttgtctctctacactgtcaagcgactcgaagaccagttctctgagctgcactctaccatttgccgtattttcaagacccatcacaaccgacagacccagctacagtgtgtcaagttccttgcatctgccaaaaagcaggatattttccccgaatccacgcttccaaagctcgctgacttgatggctgaaatttccagcgactttgccaacgtactgtcggaccctgcagctgactggaacacaattgcctccgctactcagagagttgaggtcctgtgtcagtttatgcccttctctgaaatatcttctgacgactctcttctggacgaagtgatcgcgaaggtcaagtctgctgttgaagacgacgatgcaaacaccgagattggcgacttcatcaactctgccatcaacctgcttcgtctccagctgctctggtccattacaaacagcgattcgtcttccgactcggcgtcagattttatttccgaggtcctgggtgccatgaaggaggtgttcatgaaggaggatatgcctattagtgccactattaagacggcaggcctctttttggagattctcgttgcactgaagatcaaggacaagcttacctcggtaggcgatatcattgacaatgatgtacaggcacgtatcatgtacctgttcatcaatgccgagtacacatatttcgaggatcttggggaagacgctcctgcgattgagcgacttcccgctctgttatcgtcggacgacgaggaacaacttgaggctaacctggagtccaagaacccgttggaggacttgcagtggctgctgtcgaagatctccttggctgtgacagctaagatcttggacgaaaagtggaactcacgactgacacttaaccagaagttgtatgggtaaatatgggactattatcgattaagggaggttatttagacggctgtgtaactaatattatgatgtacaatacgactactgtttgattaataaatacatttctataattacaatttgcttagctttctgatcgctctcttgtctccgccaatctgatccagtaaagaagagatcacctttgaggggttagattcaagagccgccagcactggggttcggcttgtgtaggggaatttttgagcctttttgtcaatagagtgatcaatcacgtgagtggcatcctccaaccgggcgtctttacgggccagcaggccttcgatatccagactctctccgtgggggataggatctgggtgggttggagtgatgcagtcaaagtccacctcttttcgaagcacgtggtcgatatccacggcggagaagaaagcacagccctggggaatgtcatcaataccagattgctgacagaacatgcctcgagtccagatgttggacacttgcagagccatggcagctcggtaggcatcttcgttcttgaccaggaatcgcagctcgtcatgcacagtgatacagagtcgcatgtcaatgtcatacttggctgcaaggtactccatggaaactacaagcatgtgcaggtagtcgacacctgacgactggatggtccagttgactcgagaggtcatgaacgatgacttcttgaggttctgagaggagagagccttggtgatgacggctcccagaacaggagtctcgggcatatcctgggtggcaatctcttcgagcttgttgaaaagaatactctcggttcctccagagtacttaccaatcgagtagatcttcttacccttggtagaagtgtagagctggcctgcaagcgtggaagcttcggcatctgtgacattgggagaaaactgcttgagaagcgcttcggcaaacttgagacctgctccgtagatacggccgtagttgaagattttggcctcgtttcgagaaattcctagaatcgaggctgtcttggaatgaaggtcggtgccttcggactttgtgccctccagagtcatccagccaatggcggtggagccgtggtttttaaaacaagagtcgccgtagagagaagcaatccacagctcctcggagtccacatctgctcccacaaaggagtagcccggaggagccttgatcatagacttgagttcggatccgattcgattcttcttggcgttggaggctgtcagccaagtattctcaacacatcgtcgggtgatggtgcccatgggaatgattctgggaatgataattccaaatccaggaccacggcccatatccacaccatccccgtcccagatgcagtgctgagacatgattcgagaccggttggacacccagtaagaggagcagacagacatctcgaacatctccttggtctgggggttgtctgagctcagggtccccttctcaaagtgtcccaggaaggacttgcccatgagctgtgtggttcgagtgttaccgccatccttatgaggaattctgaaacacagggtcgagccatcatctcgaagatgcggctctgtatcgagagtggccagtttgtacttcttggcctcgaaatgagcctgctcagaaacaggaactcggaacatccagccttccttgtcactccaaacaacagggtaaccttcccatttcaaacgcagcaacaacggagtgattcgtgtctttgtggtgatatgcataggtccagcagacgacttgaacaaggccttgtaccattcagggtaaccggggaacttgacgttctttggaagccgttcacctcctccttgcttggcaggaatcttcaccatcttgatgggcttaatagtccagtccagctgcgacagccaaggatcgttgagccagggctccttatcagcctcatccttgagcttgactgcttcagtaaccaaagactggagaccttcgtcaatagatttcttcatcttctggtacatgttttcgcaccggttaaggtagtctttccactctgagtctgtgggtaggattgccgaagagatgttcttcaatgccgtgaaactgacgggatgggggcacgtatcgaggaacagcggaagaatcttcttgaacacctgtgcggtgatttctacatcagtgatattgtagtcaatagcctgcttgacacgctgctgcagctcacccaacgattcttgactgaaaagctcacggtcatccttagacatgacgagtccgttcaaatgcaaatgagccacttcagctagcgaatttgtggcagaaaccatgacccaggggtcctcagagtaagcatctgcaagatcgtctgagatatccagcagctcgttaacgttctcctcgttactcagatcctcatcatccaacagcttcttcatacgtttctggccctttcgagccttcatccacgttcctcgttgtcgagaacacatgccgttgacagaaacatgcagtgacagagtatccatgaaaaagtttttcgtctgcttaagggagtactcttccttgactgcttgacggtcgtagccaatattgtgtcccacaatcacccgaggttcatccggtggacccagggggataagatgcattgattcctggggatggttgacaatcaggttttccccatctagactcttggtcttttcctccacatccacgccagtttcgcgtgactccaccagccagggactgagccagacataccaggcctcagtactcacggcgcttgccatcacagggtatccactcaccttgtagagcacctcgatatcaaagaccaggccgttttctttggggtaatctactcgctctggtttcttccccttggcgtatctcatccatccactgatatctgtcttcacgtccctgggcctaggtttggcagggaactccttggtcatcatgccctggataatatccatgtagggttcccccataactttagccattcgatagaaatgctcgtccagactggatccaagcattggaggcaagtcgaaatcgatgatgttttccttcttggtcttcttgcccagtagttcgtgtttcatcagatgatgcttggccatagcctccaacttaaccatctcaggcttggtcaaggagttagtctggttgtagtccccgaaaagctggttgtacaaacctgaagacaacatctgaatccccatggggttgattcgtcgtccttcagagtcaacctcaacgttcccttgtttcattgccttgtgggccttcttcacaggctccttcacatcctccacatcctcccaagcattcggatccatattcatgtggtcaaatgtgtcgggaaatactggagcgccctgtggatcaaaagtggcatcccatccaacggctccaaaatcggactcttgtcttctgggaccaggtctaagagggatggcactgtgtgtcaataagcggtggagacggctgggcgagggcacttggcgggtaacgtaccctatgccttggctccatcgcctggaaacgccccgaaaccgcagcatcgtatatgtcgtcaggtcgggcggaaactgttatcggttaaatctagtctggtgcttgtaaatacacctgcactttaggcactaataatttagatcgcttgcagcatctgcaaaaagttcgtgcctaattgggacagtggtgtgtgatgcgacgaggctaattagggggctcaagaataatttttcagtacactttcgaggagaggcaagtgcgatctcaagccggatgagttgccgtctcgcttgaaaggttcattgcatgaaggtaaatgccacaagtgacatagtcataatctgttcactcataacctgtgaacttgacgtggtctgtatcgtaattacaagaagtatgtacggtacttgtagtgtattgtactcgtcccatggactcatgtcattaggaaagaaccatttgaccatttgccaccgaactacagcacccaatgagactctaacatagagcaacgtcactaatggccgataactaccgtacaaatacccaaataccccttaccgtacctacgtaacaagtccattgttgagtccgtacgtcactgtcactattgccgcaaaagccgatggacgcatatccgttgcatgggacactcattttttttccataagctctgggatgaaaaaatgagtggggatttacacgataggtaaaataggtggagtagtgatgtatagaagctaccttttcacggttctccgttgacgtattatcacagtatgattgtatcgaagctgcgaccgtgctcgctcgtacgatacatgacataaacgaggcggactccatgctacagaatgtgatgtacgaggagagtatacgggtacatgtgctcgtacctacagggtacgattttctaggcaaagcaacgtattcgggccgatggggtggacctgtattgagagtggagaagggatgggtaaaaaaaaggtaagcatcgcctactgtaggtacttgtagggaacagtggggggtgggggacctgacgaatggttcacgtgacgttgagggttgactcataacatcttcgggctgtaaaatattatttaccatcaaaaccagacatttccaattcatgtcccaaccgatttcggaaccacgaaaaagacaagtgggctacaagtgtcaataatggtgagattgacaggaaaaatagggttgagaacggagctaacttctattgtctgcacacttagggttcatttaattataaccctagggtgggggtcgggagaatttagccgatggtgtgaagggttgttgtaagacaagttacagtgcctgagacacgttgcgcctcctacaatagacaacgacatgtggattacagacggttcgctgtcttctatttgcttgtccactccttataccacgttgggccaaagtgtctcaggaatctgtttcagtcccataaataaatacggcctaagtttttctaggcttggcgatgtggagtacataccccagtagctctgttggccgtgaggagagagtatgagagcactcatttcggctgttttgcagttttattttttgcgcaggctcaccgctatcagattgatttaaccatgcggctataccgcaacccgacagtcctaatggttgtctaaaagtgtcgtttgcgtgcctgtctttgtccacggttgaacgtcaaagtatcgcggacctgctccgtcccgagagcaacattactatgtctgtgctggttggcccagaatccagaggcgtgatttatagagagtagtacaagtagggtatgtacaatattgcactgatacgcgtacagtagtgcagcccgatcagtttcatacaactaagtgcactgcacacttgtagtttgtagagatgttaccgagcgaagcaaaatattgcgcactaatgccgctggcctcacgcccgatattatggcacacgacgacaccatcacgacttgggatcacactttcttttcgacatctgcacagatctcctccaacttcccttgtccatctcatctcatctcgatgcagttgaaccccctcgactacaagatgagcgatctcagacctcctgtaacatctcagtgagcctgcagagagaggtgtgcatggcatctataggtctgatggatctgtctcagccaagacagagacaccatatcgacgaaggagaagttggggttcggaaacaggaccgaagatcaaagagagccctaacttgcacaaacaacgaccgtacccttcgtcgaatcgtacaagcccacttgttgtatgatgcaacccttgtcttcttgctccctgttttaacctccgattgtcttcccagcccgccatgagcccgcccagggcttaagtcctaaagcctttagtggaggttatttgcagaaaagttttgggcgacaaagcgctgtcaaaagtgggtataaaacgaaactatagagccgtaggaattgtctcaaagccaccatggaacaactgtatttgtgacatgttcaccgaagcaagtgagccttctctaggcttaccagatttgtccttttgacacttccatttggacagccagctgtagctcgctaggttaaactccaaggtgcacctgcaaccaacttttattacccaacccaaatgacggaaaggcctcccttcatgcaccaagactctaatgggaagatttatagtatacttgccctttgtgcgtatatgtatatgtgaagtgtcggtgaaggggatcctatcgcgaaatctctttttcatctcatccgcttgcccaccgagaagaccgcactacgaccgggtgcgcgcctcaagctacagcggcaaaaccggagttgctaatcacatcgacagaaacacgttatcaaaagtgccacacattcgatctgacaacgttgaacaatacgacagagcgatacagagcgcgcggcacaaaactcgcacaacgagctcaacaagtgtcgacaaacgaggttttcgactttgaacaacaccgactcacagtcgctcattacgaaccacaatcaccacatacctcggctcgtgggctcaacctctgatacacaaggcgctggtgcaacaaccacgcccacgcaacactacaaaacacacacagaatgaaatatgatgcaaccaccattgccatcactctcctctttcttattctcttccagtccacacatgtgctagctacggacgttaccgactcgtcagaccccctgtgggacagcaagtacacaacctcgcaaaaccggtcccttcgtatcgtctccatctgcttctcttcactctcgttgctagcaggaacctatggaatcttctggtttttctatcaccagtataagaagcgacatctgacaaagaacgctggatttcgaagccgcgtaatcaagttccgacgaaaactggtgctcgccttgattctgtttgacttcctcaaagcactcatgctaactatttatcccgcaaagaagctgtgtggaactccagactcgccacaatttgcagcagtcattggatggttcacaaacgtggcaattgagggtggcgatatgtctgcctttctcctggccgtgcagacagccatgatggtgtttgctcctcaaaacgagcactcaaaggacaacctgtggaacagaaaatttgccaaatactttcaaaatggtctgtatccctacagaaagtacatttacgtcttttgcttcaccatcttccccaccttgctgtcttcattggcatttgttggaacaagctacccagctgcccaggacctgggctttcgaggatatgttcctctgcctacatttgtttttctgccagcatctccgacctggtatcgggctgttctttcgtggggaccgcggtatttcatcatgtttgccattttcgcgatttacattgcagtatttattcatgtgagacgggagtttaagagattggatgtttcgatggccgaattggctggtgcggaagaaggaggggctttggaggataaggtggagtccagcaaggggtggaagagggtgcgaatctggctgagtcatttccccggtctaggtatgctgtatcatcaccatcatcactacccaggcgttgaagaggatatttatggggagggtgagaacgaagtttggcctggggttggtcgacaggagagttcttcggatttggaagctcaggacgaccccctatctacgcctccaggtagtcctactcgcaccccagatagtcccacggaggacgaagggcctgttgctgctactcccggcagaagagctgccaaccttgcagatttgcagtcgcatatcaacaaacagaatctcaagcggtttcggcagcgacgggcagacatcgagcgtcagatgaactacattttcatttaccctttggcgtatctccttctatggacaggtccctttgttcaacaggccatgcagtattccaaacacaagaacgaatacagcaagttctcgatcatgatttgggcggttgtcagccaggcttccaactgcttcattgatacggttgtcttcattcttcgagagtccaactatcgaaagtggagacgggagagaaagctgctgaagcaggctgaggagaggaagcaggagtgcacaaactgcaacgagcatagaaacaagcctcacgatgatgacaaccagtccagaagtgaggagaacgagtcgtcggccggaactataatttcgctacctacttttggtaactatgaaatgaggtttggaggaagtggcggtggagatggtccagatgtgagggaggcgccggactctcgggagtcggatcctctttcagcccctccgtcagcccctccgtcagcccctccatctggctaccagacacctacgtcggtgacttttcccccccgttccactgccaagagccccgagaaggacaatgatactgttcctgagatgatgtttgtgcggtctcctggtggagttacctttggtgttccatttggcaggcggtctggtgacctggatcgagaacaacctcatagtcagggtctttgtcagcgagactctcatcgggaccatcatagaggtagcatcagctggggctttggaggacgacgcaagagcgagttcagcactggagacgaggaagtcgatctggttgactttttgcgccagtaagggattacgagtggtctacgccagcattgtatataggctaggaccggcactatttatttatttattgcataatcactaatataattaatttcacaggagcagggtaacagcatgtcactacttgtaggtaagagtatcgtacatattgttacaatatgtacagtacaacttgtatgcagttgtgcgtaaactcaataactgatgcgcatggcccttgacgcgtctcaaccctttccctaaatgagtctatatagctgctcgtgtttcgcgttttcttccccttcccccaaacattcacacaaacacaaacataaacagcatgtctctcaaggttgccttcctcaacgaaaacgcccgagcccccactcgaggctctgtgcacgctgctggctacgatctgtatgctgccgaagagaagactattcctgccaacggtcgaggtctggttgatctgggtctgtccatgtccattcccgagggcacctacgctcgaatcgctccccggtccgggcttgctgtcaagaatggcctgagtactggcgccggtgttattgactacgactaccgaggccccgtcaaggtgatgctgttcaaccacagcacagaggacttcaacgtgaccattggtgaccgggttgcccagatgattctcgagcgaatcgtcacccccgaggtccaggttgtccagaccaacgatctggagtccaccgagcgaggagctggcgggtttggttccaccggaatcaacgacgagaagaagcgtaagttggacgaggctgaggctaaggagtgaatggcacaatcaaaagtgtggaacgcttactaatccagctctgtaatcagtcttatgactaaaaacgcatcattgtgtgactcatgatctgttaaacgacatatccaaaacaccacgcacattatttatctaattgatacacatttaaggaatttatgaaatatccccagtaaaattatgactaaggagttacagcaacagtagagttccatatcggacctgaatctccagtgactgactcagaagccgagtcacatacatacgacagtgatgttctgcaaaacagacaaacacacaagattatatataaaggtccagttcagcaactgtacagtagtttgaagctgtttcatactctgcacttgtacttgtacttgtacttggtacttgtagtgaactcaagtttcacccattcaggtctcgaaaatcagcctgaacagctgttcttgacaacagtcactttctgtagaatcacatacagagagtccttgtggtaataccggtacatgtacctgtgttattcgcattctgctcgtctaatcaaagccgaaatccgatgtggaaatccgtctcgtcagccagcatctatagctatcgcccccgaccccgcccactaaccacatgacacatctagaccggcccgatgtccgctgctttatctttagaatctagggtctgactaaaaccaggcttaattttcgttcgaggccaattgtggggcttaaatttataagcaacaagggtttgggcagctagtggggtgattggtttaagcagatttggagtccgggtatctgtcgaaacacttcccatatcaccggtcgggcatttagacattgttcagcgagtttcattgtcctcggacccgcctcaatttcgatcttgatgcaatcgacaaacagctcagatcgtgaaaatttcagatttttagacttccagccaagcggtgtataaacacatcgtaggtccacatagaaaaaggaccacttcgaatcacactttaaaagggtgcaacacttgctactttgccctcaccacacctactgtcacacagaatcatgctacgactaaagactccggcccgacatctgtttgcccaggcacgacgtttccagtccactaccgcttctaatggcaacggaactgcagtggtactggttaacatgggaggtccttccaccgtacctgaaacatacgatttcctgctcaggctcttttccgacaaggatctgatccctctgggcccattccagggtcctctggccaaattcattgcctggagacgaacccccgtgattgagaagcactacggagaaattggaggaggatctcccatcagaaagtggtccgagttgcaagcagccgaggcctgcaaaaagctcgatactctgtcgcccgagactgctccccacaagccctatgtggctttccgatacgctaacccccttactcccgacacatatgcccagatgaagaaggacggcatcaagcgagccattgccttctcccagtacccccaatactcgctctccaccaccggctcctctctcaacgaactgtaccgagtgcgaaaggagctggaccccaacgaggagattgagtggtccgtaattgaccgatggcccacccaccccggtctcaccaaggccatggctgacaacgtcaaggagcagctggctgcctacgagaaggagggtatcaaccccgaagatgtcaccatcctcttctcggcacactctttgcccatggaggttgtcaacaagggcgacccctatcccgctgaggttgctgccacggcctacgctgtcatgactaacctgggcttctccaacccctacaagctggtgtggcagtcgcaagtcggccccaagccctggctgggagcgcagacacagaagatggtcgacgagtaccagaaggccaagaagcccatcattctggtccccgtggcttttacctccgatcacattgagactctgcacgagctggatcttgaagttcgaggagaggccgagcatcccgagctgattcgacgagccgagtctctcaacgacaaccctcttttcctcgatgctatggccgacattgtgcacactcatctgcgaattctgaatggtgacgtgactgccgcggaagttgccaaggagaagggtcttcagtccaagattctgcgaatcaagggtcctggagcccagggcgagcgaggcgcgttccacgaggccatcaacgctagcggatagatattctcggacggtttgtaaataagtaaattagtagataagtatatagaggtgatagacattggatgagcaatgatggatgaagatgaattaagatgaaagtcgtcgtagagatgacgcaagagacactctccacactgagcaacttagaaacgagcttgcagctgggaaggcacgccaatgcaagtagacggttatctgcacagcagcttctcgccattaggcccattgtttcacttgcgctcttgactgtaccaattagatacaaatgggtacgaactgtagtggaacagtcatcatagggtgtagcgaagcaaatacgcgagactgaaacactgccctgtgaaagctgtgtttatactgtctcgaaactttcagacctgtttaacgccactgacaatcaattgtacctccaaagttctgaacctaactccaattctaaggcggactgggccagtatataagacaccatggggaacagatactagcaaccatactattcttctttatcgtacaccaacaaaatgcccgacgaccaccgagagtctggccacgaccaccccgtcgaggtggaggatctccagagacactaccagatcaagctgatcaagctacaccccattgagaatgcaatcttcattgctaagttcttcattgtgggtctctacttctactacacattcaagattgactaccagtactacgttgcgtcgtacggctgggaattggcggctccaattggtgcgctagcccttgaatggatcacctatcctgttgccttcgtgctgcaatatacccaggagactggtcgacagaagtaccagtacattcgactggcagccagtgtggtggcttggattattcgattcaccttctacggtagatacgaagttagacgcgaggttttcattgttgttgctgtggccatttcctccattattctgtggtttgcaaagtggcgagttgctctccaccagcgagccattcagcgttcttttaacagagccgttgatgttgatcctgagcaacaataagcaaactgggaggtcaattgacacactatatctaacttaacacattcatttcgggtttatgacgacttttgtactgatgaggagcattgagcgattgagagagaaaaagagtggtgttattgtgttttagttgacaagtcaacaaaccccaagtaatattgtcaaacttaattctattgtttaatttaggcgatatgcgatatggaactgtattggaggtggggggtatctacttgaaaagtacaggacaaccacttaggcgtcgccaaaacgcagactgtagaccaaaaaagtacatgtttaataaaatcaaaagatgcacacaggcgggacacaagctgacatccataacacactcgactatccactgtagcactggctttaatgctctcatttataattaaacatacacgtgattatagagtttgggtgcaccttgtctaacattgttcgttgctcaccacgagacttgagcaagattttttgtagggaacttccctaggaacgcgagctttcgacaccaaccacccagtccctcaaacatggcctttccatgggcagataagtgggcagccgatgcgtctgcatctacagggctgcctccggacctcctcaagattgcattcactctggtcatgtcttatccgctgagttctctcatgaaacggctgccagatgacgccaaaaacctcaagatcatctatatcatctccgtgtccatcttctacatggtgggtgtcttctccctctatggcggagctgccactctgctcttctcctcaatgggtaccttcttcatcacccaatggaagagcccttacatgccctgggtcaattttggttttgtcatgacccatctcttcgtcaatcacctgcgttcgcagtttttccccgaaacatacgaccccaatgtcattgacatcaccggagcacagatggttctgtgtatgaagctatcgtcttttggatggaacgtctacgatggatggcagattgagaagggtgagcagctcagcgagttccagactaaaagggctgttctcaagcaccccagtcttatggacttcctagcttttgtgttctacttcccttccattctgacaggtccttcttacgactatatggagttccataactggctcgatctcagcctgttcaaggagctggagaaagataaggaccccaagcgagctgctcgacgaaagcgacacaagatcccccgatctggaatcgctgcttccaagaaactcgccgctggtatcttctggatcgttctgtggacccaggtggactctcgaatctccaccgcctacgcttactcagacgcattcaccaaggagcacaacatctttggacgaattgtgtacctctacatgctcggtttcatgtaccgactcaagtactacggagcctggtccatttccgagggagcctgcatcttgtctggcctcggattccatggcgtggaccccaaaactggcaagtacaagtgggaccgtgtccagaacgtggacccgtggggattcgaaactggtcaaaacacaaaggctctgctggaggcctggaaccagaacactaacaagtggctacgaaactatgtgtacctccgagtggtgcccaaaggccaaaagcctggattccgagccactatcttcacatttgtggtttccgccttctggcatggaactcgacctggctactatctcacctttgtgaccgctgccatgtaccagtctgttggtaagttcttccgacgatacctgcgacccttcttcatggagtctgatggaaagactgccggtccctataagatctactacgacattgtgtgttggatcgttgtccaaaccgcatttggatacgctacccagtcctttatgattctagacttctggctgtcgctcaagtgttggaagaactcctggttcctgtaccacattgctctgggcgccatctttgcaatttctagcccctacaaggcatgggcgattcccaagatcaagaaaaagcaggctggagccgtcactgacaagaaggacgccaaggaggaggtgaagaaggacaccatcaagaccaagtaattaaattgggcatggcatactgtgtacgagtacgttagataattgtggcatagacaataaataaatttatttaatgaagctaattaagtctcgtatctgtacgacaactcttcgtcacccatccactcgtcgtgttcggagactacaccctgcttttgcagctcatcccgtcttcgattctctttagtgagcacccaccaaagaataccggtgataacaatctcagctgcgacaaatcccagagctgtggcatgcccaggtatgtatctgggtgctgtgttgcttctgtatatttgaacaccatagatgggtgcaatgtctccgatcatgatctggatagcagctgccacagaacgtttcgtttgaccagaaacattaatactgggccacgagaggagagttcccaaagctggatagatgccagcagctgcgaaacagacacccacgtacttggcaccaggggtatgggtggttagtaggaggatgtatccaatcagagcaacaacactgccggcaatgatatacaaacatctgtttcgggttctttctgccaatagagccgcagccagagtagtgatagttgcagcggcgtaaacaggaaccgtcagaagctgggaaacagtggttgagtagccaaagttgttgatgatggaaggtaggaacatggacaaagtgtatagaggaagagctagggcgtggaaagaaatagcatatagccacactctaacatcggtgaatgctctccatacccatttccattcaaaggactcttcattggctgcatctccgtccatttctagtctcttcttgacaatctctcgttcttcttcactcaagaatcgagctgtagagggatagttgaagatgagaaagtaggcagcaatggccacgacgactgtgacgagaccttcgattataaagatccatgcccagcctcctagtcctgcaatgcctttcatgaagccaattccgtaggccaggagacccccgaaagctccggccagggccgcacatgcgaaaaagagagccacacggtaatgaatctcgttccgctgataccacatggagaagtaaaagagaacaccagggaacagacctgcctctgtaacacctagaaagaaccgattggctagaaaccccgaggagttggagaccactccagtgagagtagaagtgaccccccaaagcaacatgaccgtaggcaaccagattcgaggagtcgttctcttgagaatgatgttactaggaacttcacacagaatgtatcccacaaagtagagagatagagaggtgaggtagtctgcatcagacagatttatagcatcgtttagtccttctagacgagcatttccggcattagaacggtccaaaaatgatagcaggtagagaagagagagaattggcagcaaccaaagatcgatttttcgcacaattctcttctcttgactcttctcttcaggtgtcaagtgcgtgtgcgtgtgcgaatgcacctgaacgatatcggcacttgagattgagagttgtttctcggacatggtcaattggtcaaaatgaagatacgttagggtcgtatattttcttaatcgccagctatatactgccatttgttggacacattcatatgctgatgtctctgaaacacaagccactgcgttatgtccgccatttccgacggaaagctgcaaatgtggcgttttcagcctggaaacggagtgacagcgttttagcctcatttcacgaggagccgtcaaaagaacgaataccatctgctcattctgtggcttagctattttagagcaagttccttgtagatccagattagctcatgccggcggcatcacgatgtgtccaagcgatggtgaatagggggtattaaaacagatgttggtaaataacggcatttgttttgtaattataagctgattaatttatccgaaatggtgcgatatacctgttgattcgcacaaatggcaattttagaccctcctttaccttccattgcgtgcttcagccacggctgagctaccagaaccataaacctggagacagggggctgcggcttctgtcggaagtgtgtgtaaccaattggggactttgttccgatagatatggaagactggacagtgtctatgcattaaccaagcctcaggtggctcggtttttaccgtatctcttgtccattccataattcaagttttcacgctcttgaagtcaatctataccctaattgcaagactgacactagctacaagtagctacaagtagtgatagatagatggccaattataagccctctccatccagaaatctaacgtgcaatgagcttttggctaatgctccattaggattctccttgaaagagtcatcagcacatgcgatggccagcatgtcgccggatgtagagtccacgtccagacccatgacactggtgggcatatgagggtactgcttgagacgtcggcgctgtttgccgtcccagcagtagaccacaccgtctgatcctccagtgaagaatgcgggtgtggctgggtggaaggccactccgttgactggatgaacctcaattcgaccctgggcgtcaggctccttggccctatggcacttgaatgcatatttttgtgcctggacttcaggcgaggggtcaaaccattctaccgcaactcggccttcgatcgatgtgttggcgtatccctttccatcaggcatacttcttacttttcgagtcatgaacttgagggacgagtctcgacgctgaaagacctggcccatgtttcgaatgtcgtaaatgtgaatctggcggttgcccagaccacaaaccacatagttggagttggtagccttgtccatggtgtagaccttgcctgctgtgggaatcatcatagagctgtccttgtttccaaaacctccccgagcgtcaatgaattgcaggttcttgtcccacgaacccgacacaatcagattgttgccggcatcgcaaaccactgacgagatggcatctgcatgctgttgtcctatgctcaaaagttctcctgcctgaagatctattgcttcaaccacacctgccaatcctcctgtgaatgcaacaccgttgtccccccaacaacagtcgagaatcgggctggatgcagacacctctgtgacctgtcgagaattgtcgtgactgacagagtacagacgcagtttagtatcccaggaagacacaagcagatgcttctgaggaccccatgtgaccttcgatattaaatcgggcaaagcgtcgatttgaactgggttagaaaatgtcgctgacaagaagaaaaatcaaacggatactcacttatgctcattttttggacttgttatcgaaaaccgatattgttcgtgatgttccggcgtgtatacaagcttatgcagatcaacatgcgtggttgtcatggagacgcgtgtcaaatcaggaggctagggttagggttggaaacaagagctgggccatgtgggggatctaacatgagtgtattctttccttgtctggagtttcgagcttgttgtaggcacaagtacgacaatacctgaagatgtatatggttgaagactatggatcaagagagttggtgatttcttttccagcccgaaaacagcccactttgactttggggttttcatcgactgggttaatcggtgtaattacttgtacttgtagcttcttgtagttcagactgacatattgaatgataccaatgtttacacactacccactgtattgttcgatgacctccaaacatacaatgggaaaagtgaaacgaacgtcatcaactcttgtgtactcgtacttgtagtttcagatccatataagacgacaaaaggatcttgcatatgagcagtattggccactttcatcaagtgtggcccaagtcaattatcgggtgagagagaggcgtgaatcttgatagtcaagttcagttgaagcttgtgtgtcatgcctctccgccttcaaatatctatacgggggaagagcaagaatagcgttattacagaggctgtaagttggagtcttgcctgtaattcggtgacagttggtgcaccgggtcgtgtcgcaaacggtctcaaaaccacctccaaaaccacttccaaaaccaccacttctggtccttgtttcagagaccttctccaagtcataatatccagctactgtacgatactgtatccaagcaggctgaacaggttcgtatatctgcatgcatcttctgaagttaatcccaaaaaatagagaaacggcatgtagctcaccgaagttcacattggagagggtactcttgttccgtcaggttaagtggtccactggattctcaagagagaacatatccagctttcattctccagctgcacccttgtcaacatttggggtctatctaacccctcctcaaatagggtaaaagagcaatcgtcaacagtaggcttttggaatacatgtgtgatgcagcaacatcctccaaggctcagctggatcagtgtttgtgaacctctctcagtgaccttgtgagatattaacggcatcacttagcgtaccacgcccctgctgcgcatcttgcatcatgacctcgacagtggaattggccgagccattatcgtcacagcgcaatctcaaagccatcagcctggcgttccacaaccaaaacgatgatcaaaatctgtcattacaacccgtccactcgcacgacagcgatatcgccaatgggagctcgaccaaaagcgatatctcgagtttggacagctcgcccaagaaccactcagacagccaccataagggtcttacagatgatgtgtccgctgagaaactaagaggaggaaaaattgcagactcggacggcaacgtgatgagcgacgcctccgattcggagctggacacggacggccccgaacccatcaacccccatgctaaattgtcggtcaaactcatggacaagatgctggccctagctctgcctcctaaatcagctgcagtggccaagagagtcagaatccagcagggccaggacccctttagtatgaatctaatgggaaagaacttcaggggcgtcacgtcgcggttcaccatcatctacgaaacctactataccgtgctggagattctaatgtggaagagaccgtcttttacgctaggagttatggccatctactctttcatctgtttgcatccccgactgctgttcatcaccccattggcatacatcatgttctgtgtcatggttcccgcgtacgcctccagacactacgacgtccaggagaattatttgaccacccaatggcctaccattgaacccaagattcctgctcctgctcccgagttttccagagacttttacatcaacatggtggacacacaaaatgcgatgaccgacttcattcgcacttatgatatcgttgctggcattctggcacacttgatctactttgctggagatgaatcactcagtgctgccatctactttgttggaatgcttggggtagctatcttttatgtatacggagataccattctccgtatcatgccatggcgcttcttcttctttgtctttggatgggctgtcattctactgcttaacccgatgctgcatagaatcgtcctgagagagtacaagaagctccctcacgagacccgggagaagttcacacctgaggctgtaaaggaggtgattgatgaactagcaagagacgagttcctgtaccataccgccgatgatgtgagagtgatagaggtatttgagctgcaagaactggatgttcacacgagacaatggaagacggctacttatgttgcccatcctcacattccgtccatgcttcatgagcccaattactatgctgatcctgacgacttgggtttgagccctaccgcttcagctggatctgttgactctgaatctcgaatcctacctcagttccgtcacacaaatggtattccagacaggaccttttcgcccccgccaacgaccatgggcgaggccatcagaaacattgaagaggaggtgtctatggcaacctacggggttagttctcttcatcagatccctgcgcccccaggagtttattcgttagaggaagttctacctcctacaggatggaccttcctggaggtccctgagagagatatgctatcttctctaccgcggtcgtccgattgggaaatggactacatgcctgaacagtgggtagcttggtggggtgcctggcgcaagtacctcgagattgaccaggacgaaaagtgggtctatgacattcttcccgacggattcaggggtacttggagaagaagacggtggaccagtctgtgcaagcgaaagtcgtatctgaagtccaatgttgttggtcgtgtcggagaacggcgtgagcacgattgagccgcaaaacaataagatcatataagttattgcattatttattattcagccatatgtaattggaagtgacaagttcttcctgaacaagtatggtacgagtagggtaggctcttgtaaccaccttgtccgttgcacagtgtacagtggttaaaccgaaggagccatgaacgtcgtctacagctcatctagctaccgtacacaaaatcccatcctaacctctaatatattaacatacgtgcccctgcgataaatacttcttaacaagcacagttggactgctcattatccagatggatgttgatggtgtcggcgaaatcgtccgtgtagtcctctgagtccacctgtgccatggcgtttcgagcaacggtctcgaaagcctggtctacaccagtgtcctccttggcactggtctcaaaatagggaatgttgccggttgccttgcagaaggcctgggctcgcttggcggaaactgcccgcttgctctcctccacatccaccttgttaccgatcaccacaaaaggaaagttttctgggtctcgggggttggcaaggagaaggaactcatctcgccacagagtcagggcatcaaaactcttggagttgttgacatcgtagaccagaacgcaacagtcggcgcctcggtagaaagccagaccgagggattggaaccgttcctgaccggccgtgtcccagatttgcatgttgacttttcggccctcgagagtcagctctttgttgagaaagtcggctccgatcgtggccttgtattgtgtgctgaacttgttgttgacgtactgttgccttggttagtatctgatagtaggtggaagaaagcgaatcaagctgtgggaaacgatgtcattcgttgctccccatctctgtcttctcttcatctgtggcataatcccaatgacgattttgttgcccaacaaccgtttgagtcgacgaaaggttgccatggtagcacatcaaccagggggcccagcagactgcgctttgtgttggtatacttacatcaacgacgacttaccaacgccggagtcgccgaggatgacgaccttcagcatggttctctttttgggcggcatggttgtctgtaatggataaggaccattatgatgtcggccatgttgggatatagaccggggttagggtaatttgccgtgggggaccacaacataggagcgattgggaggtgcatgtgacgaggaaaaggtgctcagggggagatgagctgatgtggggtttccaagggggataaacgggggggagatgcagattatatagatacgaggtgttacatagagtgtgtgatgtgaggaggagggtatcatgtggaggaaatggttggtaggtataggcaaccttgatgacgtaattagacactccaacatctaaacgctcattcacaaaacctgagggcagaggatatttgatgaacaattttagtccaagagtatttctaatcgtgacttgaattgagggcaatagttgatattccagtaagtacagtacagtacaatgctcgtactttattgtagtaaggaagagctgtctgtttcggtgtaaaattatggtctgaaattctctttgccagttacgtggatacttggccatttacttatctttacttgagacacgtgcactatgcactatgcgcgcggtgtacgaatactgtaggaaggacaagcagagatgatcagagacacattccgatgacagttctgttataggtggcgccgaacttttatacctactgtcatcacaaccatcatatctcgttactttgctattccacacttgtttcctacagggcccttgtacattcagtttcactgttcacagccgtgtccaacctacatgtacaggatgtacagtatggacaggtacttggacgttctgtacttgcaaatatgtctgtattcttgtatccacttctggtatgaatacgaagaacagttcggttcctgccgtctatataaaggggcaaagtacgctctctgggggtgctttggtcagcataatcaatgctgcatctcgtattgtgctcacaattgtttttgttgctggctcccagtgtcgttgtaaccttctgaacagagtgggcaggcagccatttatttgacaaggtgtcagatgaacagccgccaaacgtggccataacggcaatggaaagtgaacaaaatactggaatctctggtataaatagacctcaaacttcccagacaggttgtttaagtcgggtgaatttatttccaccctctctcacctctcccagcatactctgctccatccttttcagtaagtcctcccttcaccgtctcgtctgaaacaaacttttaaagggtacaactacaagcatctcgtgcagcaaaatcaaaaagtcgccaacagcatctcaattctgcaactatcggtcttctttagtgcaacgacacatgtgtgagtatatatgggccaggactctgcatttcgagccactcaatgcctcagcactaacttgcaatgctacaagtgatccgtactaacgcagcttcgtcaaaacaggtgagaacagagaaccacgaccacgggcgacaatgagacgaccacatgcgataaggacgaacaggatggaagatacgaacaacactcggggttaaagcgacccagactaggtctggaccctgggatgccctttttcgtgcccagaacggttgatagaatattggtgaaatgttctagacccttcagatcagccgtgtcatgattcgaaagaagtcatgatcatcaacatgatatccgcgcacccagtcagtcaggtgaagtcaggtcgatactcgcgcccattttactatttcactactaacatagccaaaagccaacgcgctgagaagccggatttcggcgcctccaggctcggccagctctccacggtcagccaagagagtcgcatcagctggaggagtgaaaaaagctgcaacagccaagccaacctccacgcggtctgctaatcagcttaagaacaacgcactctttcaggccatcaagggtattcccagaacatctccgacagcccctgcccaaccagctcagccacgaccaggccaggagttgagagaccgaatctccggaaagacgcccgcaaagactcaagcgccacctccagctaagacaaagatcccagccaagcccgcacaccctctggcaagccggttcggccagcctcctcttcctaagtccaagttggacaagctgggcacaacaactgctccctcccacagcagatacaacggcagcgacaccagccgctcctacagttcaagccatagctcatcgagtgacaaccacagatccacgcacgacacctcggcgtcctctacttcttccaggagagacgacaagcacgtacgaggcggtggacacgacaagtatggcaactacgacaagtacggaaataacgacaaatttggcagaagccaggagaggtacaacagtcgagaaagagagcggtacgagcgaacagggggatcggatagagccgtcagtagcgacagcagagacagatttggaaacggtggacgcggcaacgaaagcaggaatagatacaacgaccagcctcgatcccaggcccaaagctaccaagagtctcgggaaagatactctgaagatcgagtgcgatacagagccacgtcccctcagaagcatactgctcaggaggccgttgctagtcccgctgcgtacgccaatcccggagatactgttgccgttcgacctgctgctcaggtgtctaacacaaatttcggtgcaaaggtaccggagctgtcggccaacggaaccccttcatactcaatcaagcatctggccatgcctcccattgttcagatctccaatctggatcgaggaaccactcgagacgatctgtacaagttctttgttgagctcggcgctatccgtgactgtcgcattcttactctgggtacacagggtgctatgggtgagatcacgttcgaagaccctgaagctgctaaagtcgccttcgcaaagttcaatggcgcactagccgatggacgacgactcgtcgtcaacattgtcaaatacaactccatcgccgaccagaagcccgtggaggttaacaacgctgtgcaccactggcctggagctggtaatcttcgatccgacggctatctgaacaagtaggaggttatgtgcgagtatttgaacagaggatgtatggatgagaggaggggagaggggaaatttgagtacgctggagacgacagggcctcacaagtggaggccttgggattcgttcgacgtgatgctctggaaaatggtggtgtagattgggtgatctacatttacggttatattgtataatgcatgtttgtatagtaaaagtagtacatacggtacagtatgtacgtactcgtactcaggagcacgacaccgttccggaagtctcgcgtaacgacatacacacccttacaatggcagtattgagtacgttcaagacagttcaaagtcattgtggacgagacagggagtacccgcgcgggtaactaaattcagacctcgttttaggtctactgtaggacccaagggttatctgctgggttcacgatgttccaacacgacctagcccaggatcgcagccagcaagaagccgtgtaggttttttattacgtgccagtactgtactgagaaagtctcggcatttgttgatatcgctcgggggttgatcggagacattggggtggtatcaaagttgcatacaagtacatccagtgtacacacagtcgcatcgtctgggcgatgtgatgcattatggttattggaatgggaagaattttacgagccatacttttacgagcgcaaacaggttagccggaatccgagatgtggacggagtccacggttctccttcttcttttttgagcgcatcgtgcttgtagactgggatcaacgagctaacccatgaaatgccccagccttgagtgggctgagatttagcggtgaaagtacaaggtgaaaagttctaactaactaaccctacttgtagccccccaagcttgcattttccgtattctaccttctctgccttatcccggcctctaactgtggtcaatgtcgtatcaaaccaaggtcctgggtcagaaggggtctttgtcggagggccttttgcgtctcctcaaatggccatgacaaattattagtcttcccgtgttttgtcacatctgttgtcggctaaaagatgcccccagagaccgttaggcacagctatagccagggttacagggatgtatctctcatctataaatggcaaggtcacataataacaccacatctggtttgagtaactggtgatgtactatcaggtgtagaacaaaaatatgtattcaccatgggcagatttttgggctacagtacgagtagtctacggcaatggcaaacactatacgacgggcaccacaggcacaaacagtaggttcctgtaacatttccgcgcgtctaaaaaaggtctaaagcgctcgatccagtatttttacaaggcttatcttgtccaaaggaaagttgcgtaaagcctacttgtagtattgtctatgcacgctggtgtaccctaccgcatctaggattcagacagacccgaatcaaagtcactccctcccagaacaagaaatatggggcgaaaaagaaacgagaccgagccgcatttcagttgacaatcttagctaaggctacaggggtgtttctgggtatttccccttctcaggctcaaaggtttgcatcgagagtaagcccggtaaagttcttattgataatcactcagggcattatcacatttcctgacaaataattagccgtgcgcattactgcacattacaagtagtattttttacacaatggaacaaagaagtttttttagatcgccgtggggggtcaagtatccgtagatgcgccagacgcaaaagcaaatacgtacccggcaaggtagggcggaggaaaccattgtcatcagagacacacaccttattcaacacacaatgtgtgtagggctgttggatcgtcgatgacatgacaagttgatcggtagatcatggtgtagcctatgatagcaacagttgtcaacggcgatacaaacgaaagtaccggaaatagctaatcgtagaccctgcaaatacacactatactctacagccatgcgatataacccgcccgtaggtatactatacaaactattgccgcatagtttcctagcaagattttccgggtgtcgagcttgtagagcatgacaatagtttttgtaagcctaattgaggtttaaaaacactccaaaaggccagaaaaagcaagccatgcttgataaggcgtggattaaacatgaattcctttgtctgctgtacgtacattgccattcagctccacttctccacctaactgtcttgcattacggcaggtacctacgatacccacctgtcaatacgttttgctaaaatagacttgattgcgaactctcatgttttctgtatcaggcgtggctacacaaatacaagtatatctgtgtctgtataatcatttgacaacaagcccgagcctcggctagaggtgttacatccccttgcatacccgaaacgacctcttcgcccccttgacgagactgtggaatgtaacactgtttgactatgttttcagctctcccataaccctacacgttgggtttccgcacttcaatagctgaaagtattgttctttgctattataatgggtgttatggtttttgaaaatgttctttctcgtttacactacaccatttttgccatgtggagtaagtcacatgaactgaacaaggccaaatatgacccgaaacgggacagaactgtgggcgtagtcaattatgtctgtagtcaattatgtcttggggtagaatggcgtgactatgcaaaagtggtccacggctgaagtccgaacattacactaactatcaatggactttgcagggatttcgacctaatcggttagcttgaacccttcgaactcagtcgaatgaacctctcaggtgcactacaagctgaactcagtgacacaatagctttctaaacgatgtggtttggtcggagggttcgctctaactttcgtgttcaaccgcctccgttcaaaaattatcaacacatcctgagctcacagatgtaacagtgatgacacagaaattcaggtacggcaatagttgaccttggggattctatagaagcaagttttatcgagctcgcaatcccaaggaacgaccttctatgcgttcttcatgcggccttttttcatccatttttgtagacctataacatgcaagttatacatgagcctcgccggaaatactccgtgtaagcccgtaatgtgtctcaacctactaatacagtacttgcctgggctcgtttttagacgaactctccgacccccatcacgggaactcccattgtacccccaatcttgcatcagttaaaacttaggcaaggctccattgttcattgagtttaatgtaccgttggcgatgtcttggcgcgcagaaaccatgcatgtgcacatgtgtggaaagctgaatgtaagatattgggctagcaaaaaccctgatttgtgccgctcacggggagtctagatgcacgcgtgctcgttaaattgagcggtaattgatctgtagtaaaagctatataaaccagctgtcctctcgtttcaatcatcagttcacagctcctcactcaaacacaacaacatcctctttccaccatgaagctctctcttcttcttctctctacgctggctgtggccctccccattgcccagcagcccgcctccgagtacaaccagttgcttgatctgatcaacaaccaggaccttgagaagcgagacatctctggacagcccaccattgtcatgttcactgacaactccaccatctctgacaagctcgctcatgtcaaggccattattggtaatgatcacattgagaagctttacgatgtctcatctactgagaagggcgctggtgttgctggctacgtcggaaccttttccaacgagaccctggctctcattgccgatgccggttgcatctccattttccaggaagatattatcgttaagggtcttggcctcgaggaggaccttgaggagcgagatagctctatctacaccaccgaatccggccagccctggcaccttggtcgaatctctcacctgcagaaccctcgaaacaccccccaggcttccgaatacgtctaccgaaccggaactcgggatactaacatctacgtggttgactctggtgtgcgaacttctcatgttgcctttggtggccgagctcactggggtgccaacttcaacaacgacgttgacgaggatgaacatggacacggtactgctgttgcctccattgctgcttccatctccaagaacgcccaaatctatgctgtcaaggtccttggaccccagaacaccggttctctgtctggcattctcgctggcatggagtgggctatcaaccacgctgctggtcagaagggtcaatctgttatcaacatgtctattggatctgatagcactgaggtctacaagactctgatccagaaggcccttgagaagaacattgccctcttcttcgctgccggcaacaacaacgaggacgcttgtacagtctctcctgctcgattcgcaaaggacttcactggtgtcttcactgtcggagcctccaaccttgccgataacatggaggactggtctggatacggtaactgcgtgtccatggttgcccccggtgttgccatttcctctgcctctcgacgaggagatgacgtttggacctcttggaagggaacttccatggcttctcccattgtggccggtattgcttcttactggatgtctatcatcaactttgaccttccctctctcgagtgggtcctcacccagagcaagggcctggtcaacacccacaacaacacccccaacattctggcctggaacttccatccctaagcacctcggatcacatccaacccactcattaactcacattcattatagacatagatagatactaatagattgaaacgactagaacctcaactgatactgtacactgttttatagtcctgtacagtatcatccccttactccctgttgtgctaaaaccgccataataattactgttgtcctctataaacattttacttcttgtccagaaacttctttcgggcgtcctccagcatggtttgtcgctgcttgagcagttgctcctgtcgctcctcttttgtgttcttccactccatcttgctggcctttgatggctctgtaggatttcgtgtgctggacgtggatgcaggttcgggatcgtacttggggggatgagggagggtgccctcgctcagatatcgctccacagtggcctcgatgttgcctgtcttttccagatcccatcggatctgagccacagatacgttaggagcaatggcctggaccacctcaatcatgctctgggtcaccggtcgccgctgtcgctcgtcgtactctcgtgtgattcgctcggcctgcagggcggcggcatgctgctcgatgttggacagctcccggaactcatcgggtctgtgagcaatgggggcgtctgggttgggattatgttcctcggagccattgaagatcacgtaccggagaacgacaaagatgactagaattgcgatcaccgcgttgatcgtcgtggcatcgtccatgttgtcagagtgtgtccaaagtgatgtgtaactggagatgtttcaccctggctctcgcgttgcttcagagttacgtgttgggagtcctgaccaagttgcagtacatgatttacgtcctttatgaagggtggagaaaggggttttaagaggagcttggggggcttcatcggcattgtaacacccgactctgtgatgtgataagcgacgcttgcaaagtggtgatagtttcggtggaattttcacatcttgcctagatctcagatacgccacagacacatgacggcaagtgcaataataactcactgtacagaaagatacggcaatacgcacattagaaattattatacctttcctcaatccgatccgggtatacttgtatattcaagagctgccctgagatgatggcgagtgtgtcaatcaccccttctgcggatcacaggtgcatgaaaaaagtgcctgctccgagtcttaaatgaatgggctgcttaaatgagtgggctgtacaatggcgtaaatgatcagaagaggtagccatttcgctcaaatgaatcaccggaagatgagatatgcatgtgatcagttctcacattctatctttgttaaatatatagccaattaccctcatttcagtacgatgtagcacgcgtgcttgtatggttatttcccagtaataaacgatcaccatgcagaggactggaaactccgacaaatcacactaacggtgcactaacggccacagtggcggagtctacacacgggactgtaggtacaagtagatgtacaaataaacatataattaaaataacagcatacacagctctctcggtcgtatccaagacattcctgtcgaatgcatccaataaatagtagcagtcgcatgagattgatacagtgacgatgatgcagtcacgcgcagatagtggcagtcgggtggtggatagactgacggaaaacggtggccttctctcgcacctcaaaatcactctgccctatcctaagggttgaactgcaacttgaaggccttgtcgtggttcttgacggcgtaaacaaagtcgacgataatctcggactctcgcacgggctgggccatgaaatgcttcttggcggcggatgcaagctcgggcttgttgactcgagttcggtgcttgtagctccacgttttctttcccatgggtccgctcagaaggtaaccgttgagggtcagagccgagggagcctgcagcttgtgcagcgacttgtattttcgcagcgactcgagaggcagtgtgtcgaagttcatggcctcgccggctgtcatggtggctgggggctggttgagctgctgttgtttttcgagcatttctcgctccttgtcggcccgctctttttctttctgcagagcggcggctgatgtggcggcggggggctttcgaggaccgcctcggttggcggagggcgtgctggcgacctcgctggaggtttttgtggctttagcgggaggcatttttcagtgacaaggtggtgtatggtgtggtttgtaacgatggttgatttgcacaatgcaaggggatgcacgaaatgagcttaattatggcacgtgattcaaatcttaatttgacaacatgagaaacagctcgcaaagaggactcgaaaatgacgatatagaaacgaaaagtgttgtttttttcgtgcgagacgacggttatggtcagtactgggcctttgttaacccttcaccggtcggtatttgatttatatagtcgatctgcacattctagggctcaaatcggtgattgcatacgcttggagtaatatgcaaggtctgggtcctaaattcagaatgtatgaccctcccatcatcattgtaaagtggctcgcaaagtcttcttcctttcacagctccccaaggataaatcatcgcaacatacaaaggatatagtgccattgagcctaaatgaaataggctcggaacacaatcaatttgttgtttggggggcagaaagagagaatgtcgttttggacactgccagagagtcggttgtactgttgacgcggtcacattcaggtatcgttggatgcagcctgacaatgggaatcttcaagtgataattcgacaacaatcgcagagactcacagttccatcgtcatgtagctacggtaccgttgcagtcacgtgatttggcatatactaccgctccggactccatgtcgtacatactgtactggtaattagagcaccatggagttccaacaaggcgatataggacgatcgcaacttgaagctggatacacaagtctaccgcagaagagacatatccttttgtaatatgcccaatggtcgatctttatcatacacacttgtacagttgctgtaacccgctacaataagcgttttccaactcacaaagttgagatctcctgctgtccaataaggaatggacactgtctgtactgactgtgtacgacacagactaaccaaaaggaaggcacgatgtactgtagttcttccgaacccatcttacaacactgtctgtctattatgagcacttaaacacacaagaaacatgagtctgacgttatcccttctgaagaagtctgtgcgagtacctactgaaccgacatcgtactttcgttgtgcagatgtatgggtaagtaagtagtcgtatttgtagtacttgtatacagctcgtctccgactgctacacacaatacaattgtagaagaaatgactgcttgcgtagttttcttctgcgattagtcgtgtcattgtcattgtacaagtagaagcgccccgtacaaactacaccggattgtccactcttgctacaggtataccgaagatctccgcacactatcttgtgcaccattttgaagactcttgtacttacaattcgctccattcatacagctgttgtactaatctaatcagctatggcaaacgttgagagctcttaaaacttcttaccccacatgatcatctggagctggtcgtagatggacagcacaccggcaccagcaacacctcgcagaatgttggctccacatcccttgaacagagctccgacaccctcagcagccacaatcttggagaaggcatcaatggaagacttgtacttgaccttctgtccagaagtcatcatcattcgtcgtcgcacagtatccagagggtaggaggcggtagaggcaccggtggtgacaacccaaccaagaaggaaggaggccaggaagttaccctcgagaggtccgacaagaacaatgggcttaagggtatcgtaaagaccaaagtacagacctcgataaacaacaataccgataacagaggggacaaaacctcggtacagaccctggacaccgtcagacttgatggtctggacatacacgtcaatcagacccttgaactgccgctggccctcaacgggcttaccatcggggcccttggtgacagacttggcgtcgttggcaagtcgagttcgggcgaaatcgagagagtagacaaagaacagagatgtggcaccagccataccaccagaggcgatgttaccgtacagagtaagccagaagccatccttctttctgttgtagccaaacatagccttgaacttgtctcggaaggcgaagttaagagcctgagtggggaagtatcggataacgttggcggtgttacctcgccagaaagaagccagaccctcctctccccaagttcgtcggaaacagtcaatgatacccttgtaaggtcgagacagacgaccctgcttgatcatctcctcctggttttggagcagcagcttgactcgctcgatgggagcggcggcggtcttagacacggcggcagacacacctcccatgaggaaatcaatccagaaatgttgagtctgggttagtacttcacgtcggatgataactcttggcatcaaccagtaagcggcagattatggggatcatctcaactagagaggcattgacttcataagtagctccaattgtgctcaacagcccaccctcggaactcttcaccttcaattagtagcgagaaccctgcataatctgctgcatgataatgcagctctgggtccattgagtcttgtctgttgtacttgtactcacatcggaacttccacccattgcgatagtttttgtgtaagtggcgagaaaaaagagtcgacaaatacgtggacacaaaaggcgcctttttttcagcaactatccaacttatatagtcctgtctttggcagttagcaaacaccaaagtagtctaagctaaaccttgcagaggggggtccggtggaaagaaagagggtcaatccggagttttggatggccattaataacaaatatagccgggaaacaacatctacggtcgcagagacgtcaattgaatgccccggcttactcaaacatatccctcatcaccccaatcaaccaccgtccatgtatgattgctaacctgggctgcactctatgcataatctcacaggcaggatgcggcattatttgcacgctattggagaagagccatgtgggtagtcggtgaattattcccgttagacgcttggagcacgtcattgatcgtattccaccatctcctgtgcatgacgtgtgtactctgcttaagaccagttcttcttgtcggagctactaaacctctcataaatggaccgtgggaaatacctcgataatacacgtgcaattgctcttgaagactaacgtggcttaaaaaaacaccttattggttgcccagagagagagctggaagggtggatatttctgagcactctatacggaagtttaggtttagggttgaaaccgcaccttggaaggaacaggttgtcgacggagaaatggcgggctggacggatggagacaagagttagcgtttggcaagtgcaatagagttgggtgtgaaatatgactggagtcttttttttttttttggtttcagcataatatatatcaagtgtgtatactttaatactgacaagtaatgaaacacgtttcgacctcccccaaaccacctatagacatgtatggatatctatatgtatatataccatctcccgctctatcccctaccctaacccgtcaggggatttaagggttgagtgcaggagtgcaggttaggggatgacccctccaggcaggggacagatggcaaagtcaggtttttccgtgattacgcggggtggcgcacaaggcgcagatgttgatgggaggggacagaagatggtatagtggagatgttgagaggtggggaggggttactgggtatgagggaaagtagggttagggcgaattatcccccttttcacgctactgtgccggaattcggccttagaagctctagttctctctattcttcatttaggtctaagccctgtccaatagtttgcacgtgtatgataatctgcgggtctagaattatgttaagcttcctccagaggtgtatttatctccgtcttttgagaccacggtgtctgagtgagcgtgtaccagtagggtaactcttttgaggggctttcgaattatgttgagagtcacagataaacgtcttgtcgcgcccccactcttttgtatggttccaaacaaattgtttatggtattcggcgttggtatcatgcacgttaacctagttttatctgatgtaatgagagatatatagcttgcggaatagtgttccgattgagttgggagtagattcagtggaaagctctcctttttagctttcgattgatatgcttcacgtgaccatatctcccccgcaccatgcgccaaatcacccctagctgcacctaaccctagccatgcagatgtaacagtgaaaaaatccgaaggccaccattctgccttgtacaacaccatgaccaacgaagaaacgccgttgattgacaagcgggaggcctctttgtcgcgggagaacagctcatcccggggcagagggtaccgcagctcttctgctggcaagcactatcctcgaggacgagacgagaccactgaagaggagagaggctcagggagacgatcgtccgagacaattgatcctcgatacaacagcacccgacgaccttccagtgccagtgttcttggaattgagcgagggggtccccgggagcatctaagcatccatgttgatgaggagagagaggggcgagactttggatcttctcctacttccccttgcctttctcgagctcagtctcctatcagacgacggactctgtactcgcccattcctctcgctcctggagcctttggacaggcactgcatactctcaactccatgtcttctctgcctacccgagaagagcgtctttcgcagctcaatcagctcacggaactgcgtcctttccggctgattggctactctcgtcctctcaccaactgggaggtgtaccgtagcgacagcgagatgcggaagggcaagtctgccggagtacggcggttctacgataaccaagacgagctcattgaccggtttgaagccgtggacaagattctggactctggaatccaccacacgcttcttagaacctacggaaccgatctggtggatgtagacgagaactccacgccggaattcagacagggagtgcctgctaacatccatgaagatcttgaatggggcacttctcgagttgagtctcagacggacattatgatcgccatctacgtcaatttcttcatcaacacagttctcctggctggtaaactgtgcgttgcattcctgacaaactcgctgtccgttgttgcttccgtcgtagactccgttctggactttatgtcgaccctcatcatctggctcagtaccagacttgtcgacagaaaggactgggagagtcaacagagctatcccgttggtcgatcgcgtctggaacccatcggtgttctggtcttcagtattctcattgttctgtcgtttttgcaggtcggaaaagcgtcagtagaacgactcatctcaggagatcactccaccgtcgatgtgggtatccctgctttggccgtcatgtccctaaccatcatcgtcaagctgttttgctgggtctggtgccgaagatcgccttcttctgctgtccaggctctcgcccaggacgccatgaccgatatcgtgttcaacactttttcgatcgtgttccccctggccggccagcacctggacatttggtggctggatcccattggagccatcttcctgtgtctctacattatctattcctggggagctacaggtctagaacacattgacaacctatctggcgcggcagctgacccggcagaccgccagatggtgttgtacatgtgcatgcgtttcgcagactccatccgagaagtttctgcgctcaacgtgtaccacgccggagaccgtcacgtggtcgaggtcgacattgtcctcgactgcacctctcttagagacggtcacgacattggcgaggctcttcagtacgccatcgagacgcttcctttcgtggagcgagcctttgtgcatctcgactaccgaagagacaactacgccggacatatcccgaggtaaggggccatttcgttttaaaaaacttagccagtggtccagtgacaatgtgcgcgaaagcacacgtccgtgacataagtcggtaccggatcttccagccgcaacactctacctccagtccaaacgggctatataatatgtatcaattttttccactcagtaaacgatcaccgaactgtactgatatggtgtgtgcataatagttggtgcgtcaaacaacatgaaaatgttaagtaaacattggtgtacattacttggaaacatcagtaatcactagcgctgtaaaccctcgcttaagtaaattcatattgtgctttggcattgtcgttatcatacaacaaataaaacagccatgagcagatcagtcaacagttcagttaatgctgccaaagcaagtaactccctccaaacatcatcgacagcattgacacagatgagtatagacacatcccaaacatatacgacacactctggataactaataatatataatgtacactctgttgtacactttgaatgtcgctaagaacataacatcgctttatacagaggacatgtatcccttcagtgacacccataccatataattttatggccaggcttcctaaatggcaggaattcgatctgggaggttcgagtggactgagtccaatctggcaacgttgcgcaaacgaaaaaacgcgcaccgtcgtggcataatacctccgtgagtttttgatcgaagaatcaaaactggatgcgacatgcaccagactatatactcgtgagagatcggtagggtaactcccactatgcatcaggaccagaccctattatacgccgtccacgatatgacatgtgtacttacaagatgtgatatgggacaagtgaatttgtcaattagttggtcgtttttaaatatggatatattaactggtttcatcagataatattatgctactgtcgaaatttcaacatcattgcgtgattatgagtcactcaaaaatgatccatccattgtaccatcgatagatctaacttcaagaatatgcagctcttttatgtgtgcctgaaccagcctttttgcgaacattactgcttcaatattgtctgtttactttccgttgactctggaagcattttcgacatcatattattattctttgcgacgaggtcatcagtttgattccactctcctgtatatgattatgtaatcaattaccctgtcaactctatttttacccgccaccatcatcgactatgcttattaagctttccgaaccataccaaccaacatgaaggggcttcgatttgggcagctcagatcgtttcacacggcgcttcgaccgctcgaggccaacaaaaagtcggagggctcgcgactcttgcccgtcaagatgctctcacaccctctgggagtgtttcagaagcccgaatcaggcgatccccattactttgtggatgaaagaacctggaaggagtggggccgagacgtccgagacaaggagaagcatatgaagaagcgaaaggagctgatggaggagtttggagagtcgcgattccgggacatgaaggaattgagacagcacaatggtaaacagtggttgtctccagcagcatttttccgggctgaaaagtctcgatacatgccaaactttctgggacgaactctggccagcccccagattgtttcaactacagataccctggagggcaacgtgtcgattgtgcggatgttcacttctgtgtttggagaggagcatgctcgatcttatgttaccaacgctgaccggtatctcgacaagtttgatctggttcagaaccgagacttccagattgtcaacttcaacattcccgagaacaaaatcaagtcatggatgctgagctggtacgtgggatccatggccaagaagtgtcctcctgatgagcgaaagcgatacttcatcattgagcatctcggcaagctgatgcggggtatcaagaatgccattggccatactaacgtctacactggctacgtctatgttgtggatcagaagtgtcgaattcgatgggctgcttctggtctggctaccgagactgatcgagagactctgtggaagactgtgcgagctctttcaaagaatgggcccgacggcttgaagccgaaggttgaagaggacgatgacgatatcgagtaatgtatataggtttcactggtcgtccagtccatgaatgaagatgaattcagcaagcccacatgcttgtgggccgtttcctttactttaggggaatgcgttaaatctacgtagtaccaatgacaagtttcgtactctagagaggttggctgggctatccgatgactcaatctgcatttacgtacagtactgtagatgattacaggttaatttcaagtgggcttgtacgagtgcagtacaaatttactcaagctcgtggttgtctatacttcaactattgcacactcactgagctcctatcacttgcaataattggagtgcacgttcatggtttcaaacgtactgtagatcggaattaccaaaccacactccctcgtgaattcactagccactgttagctccttaaaactctgggtacagtatgtactgtaacatgaacttcaccagatattgtaccgcatgtacccacggcggtccatagccaccgcatacccctgaaccctgtcacgcgtgcaatctcaagtgaccgtttggcaaagtcaattaactcctaaaatgctggaactacaagtaaattgccgactgtctgaggttgccgctgctccagagctctcactgtcttgccccaaagctaagctagtccggaaagcggggcctgtcggagctactccttccgttttagtgtcggagttgccaagagggtaggcagcattatttagcgacttgtagccagcagagtacatacacttgtttttgcagcgtcaacgacacaaaaaccctcatcactaaaaacgccggtttctggagctctgcgacacaaaccgcatatctccagaaatacaccgacagttgcagcaaagccaaactccgacgactaactccgaccaacccaccgccagtcatgagacatttattaaagtttgcatatacattatctaatcactcatcgccaccagagtcacccggtacaaaaccagtgacgcggactgcaactctcccccaacccctgcaaatgacatcgtacctgcgaggcacgcgaaaggccctggaacgggcgccccaccgcctgtttggcaacaagtccgtggaagatcgagtgattgtggaatgggccaaggatttcaaggtggcccaagatgcgcttcatttcctgacccacgagctcacaacctggaccgagacatggaagaagctgctggactcgcaggcggactttgctaccgtcttcgcagagctgtacagacccattgtcgaggacaaacacaactttaaggaaccccaggtgacgccaaagtccgtgttggcgtacgtgaccgactacgagcatctggctcaggatctggctgtggcgctgctgccattgaccgagagcctgtgctcagtagcctgcgaccgcatcaacacggtccggtctcaattggagtccattgagaaacgcctaaccaaacgagcccacaaaaagattgactacgataaggcgtccgagtcgctacacaaggccatcaagaagagcacaaactccgaaaaggataagctgcatatcgacactcttcaggcccgattcgacgaggccacggaaatcttcatggccattgatggcgaggtaagaacccaagtgcctcaatacctggccatgctctcagagttcctgaaccccttcactacctggatcttctaccagcagatgaccatctacgagctgctgcaggagaaaatcctcgaattcagtgtcacccagggtcttactgagtgctcctcggtgcacccccagagcgaatcgttccgagagatctcagaatgctggagagaccggttccctgatcccctgaaccgagcggaggagggactcaagacgatccgaggaggagagactgtgaagacagactacgacgactgggacagtgaaaagcacttctacaccggagagcgtcacgcacagttcttcgaaaaagccaaggatgacattacggcaaccaccatgggccttgtggataaggcccagaagccgttccatcacgacaagcctgtgctgttctcgtcggatcagggtttgttccagggtgaagctgaccctcttggattgataggaggagactctagcttgactcccgtgacgtcctacgatggagggtcgggtaccaaactcacccctcagttgacgccacagagctcgcccctcaaacaaacccattcccctctcaagaccccagcgtcaccaataactcgacggtctcgagcgttttctaacctctccaacgtgtcaacgtccactaacgccaactccggccctactcccatcacatgtcgcctggaggaaagatatcccagtgacgtgactcgtcgtgctcgtgcgtggtcttcttcgtccgccagagcactatcgcctcatcacatgacccttgaagaggtgcgtaagagttgggctcctgaaggcgaggacgtggagatgctcaacgaggaggagtcggggactccatcgttcggctctgtgattgcattgttcccgttttcaggccagcaacctggagacgtggcgttcgagaagggcgacactctcaagctgctgtacaacgctgagaatgaggattggtgggtgggacagaccaaggatggacgctacggcttctttccccgaaacagagtcggaatggtgtaggtctccgctagtgtggattcgacctagatagtagatgatgacgaagtagatgcataatggataagattggtaggaaaagagactttgaacagtacgtaggttgttgctgtcttggatcatagatgatcattagtgctgcagtagtgtcgcattggtgcttttctggtagattacagttggagatttgtatctggtattaaagcttgcgagaccacactgcatgtggttctgaagccgttcgagaagtgcaacgtcattacgtagttgaatgtatcgacaagtgcggtcatcttcccattctggagctttcttcttcttctcatcgccttccatctacaaggagagctgtttctctgatggggacagtgacctccacaacagtagatgaatggatggacccatgtatcttattgtctttttcgttttcgccgcctttgctatatatttaagcgcttttctttataacaagcgtagtggctccaaaacactttttcttgtttggcacaaccgttgttgtcgagttgagtttcactgagtagcagactccaacatatacatttaggagctccaggacgaaaatgtgaggatgggaacttcagaaatgtgatattttacattttttcgtaccatctttccatttgctaccattttgttcttgaggctatgaatcttaaggggggcaagtatgaagggaacgttcaattcaaatatcacgcacacaaatgcataatagtggcatataccattcagaaagattgccaagagttgaataatgtaacctttgttctttctagtgcaaaagtaaccttttagatatctcttagggtctctgattattgagccagagctgcaaaccagtctcctctgacattttcatcagtagtttaaaacatgatattcttttctcatgcagtcaggacagtgctcatataatgaatttcttgggtatttattacttcgttaaacaagaatttgaagtccccacgatgttttcttcattctgctttctgttatgtaaattgctgttgttgacactagtgcactatcatgtctcatgtagcaccccattttgcgcctgcaattttttgaagtcagcggtttcgaaacctacaatcccacctataggaaccctttcagtagcgactctgtctataacattctttcccagactctcacgacaacctacaagtagagccggaatatcagaaccaacaatgtgccaggtacaaatatccaggtctggcttgtgtatcatcttgaacaagtcaggaaaatcgaagtagaagtcgaaataaatgaatatttatttatatattgtagcctgaatcaagtagttgaagccgtgccagtttcgaatgagacttactctcctacaagtagggttgatgactactgcactcaccacttcccccttctcaatgatctctctaaatcataactatgctccatgaacctggttcgatggcggcaagtatacatttttaccagtcttcctatgtcgctttcacagcaccctgatggcattatctgtcacgtgatagtcacttccccagattgtaaaatatgctttaggttcatgggttggagacaggttaggagcctttctacaacatttcactttaatatgttcaaacttgaacccctttcatcaactacaagactcttatactcgttgcaatcggcacttctctaaccaagaaacctcggtacgccgttttgagggtctttctcaatgtcctaccacgttaaccatatagatctctctccaatcgcaatcaccgactacccaagtgtaaatcagtaaccaggagctgactttgtgttttctcgtagcacatagcacaagtaaagacgtatggaactgcctcagaagggtttccatcggtcgcaacttgcgattggctttaaactaggttcgtcggatgacaacgcttatgtgaagtaaactgcgccgataccctaagagatattttcggtccgatgagataccttacaaagaccgctagatttaattacaagtaggtctgatatccgaagaaaaggaagaggggccgtgtctgcatcaacgacggcagtctcctgcaggggtctgctggttaatctaaacgcaaccaagtgccgatatccgtgaaacagtctgttaacggccaggtatatatacgaagaacaatgagcttcttacttaatctctatcgcaccattgttttgattcgaggcccgagaactcgccgagacatgagagggtggggtgcaactccatgaaacactgatggcaaggtacggtagacgcccaagacactgtggagagactgcagtgcaggagcactgccacgaatctcgataaggtcgcgtttcaaaaatgtgacatcggggtggaggaggtctatcaaaggttctgtatatctcaagccgtttaatgggcttctagaggagtttctagaagggttcgataatatacttaaacgcgatgagaattctcgcaaacgcctaaagtatttggcacgcatattgcaactacaagtactacaatctctggtcgatacacgagatttagggcactgtgatcagtcatagcaaacatctatgccttcgatcaagcctatatatatcatagaaacggctattaagggtacctgcatgcattatctagcctagtcatggtactacgtatggacccatctacgtagtttattcgtacagaaccatgcccaactaactacaagtacatcgatccaccacgtatcgaatacgcttgcataccagctgccgtatcgtcttttcaaaccgggccaaagctacaggttggttctactgtttttcgctcaacgtttggctagtctcaaacccaccatggtggtgcggtagtctaggtacgggcactagcatacgacgagatttggtacgatagggtcttcgtttcgaaagacggaaagtgacgtcagcgaaaatcctagaggcataaacgctgtgaatactctctaccccggtctacggatcttctgctcactcgaactctccccaaacgtacgagaagacagatacatacacttttgagtgtccactagcgcggaatggtaactcaatgtcgtttcttttgtccacttgtttctcctgtgcatggtccatgttcattttgtgaactgaatacgtttttaaaaatcgaatttgaaattaggcgaaagaactgcgagagctctggtggggtcatgttgccattctaacagcattggtcgtcccaattatcaatatggactgtctttaccatggcgtccaatctgaacaccatgtacagtagcgtcccaacagtgttccggaactatctacacacggctgagacacattacgtgataaaagacggcgtgtacggacatgagcactttgccccttttaaagtcttgctaccatcagcccagactgtaaccccaacctcatgtgtctgaaagagtcttgacttcgcccacggagaccctgaggagttgaacaatcgagtctacggtgcagtgcattagtgtgggaataatcgcgccaaaatccaagccaaccacttcccgcgtgtactaagatcgtattttccacttgagcgtcgtcataatcgtcttaaggctggttctcgtcaacatgttggagcacaatctgccggaagcaagaatttcaacgccctgtagcaagggttggtcctgtgataatcaacagacaaattatgatcagctagattaggacaaagagggtcccttgattggtgtttgttgggaatggcgcattctgtttaacagcaatcttttacgagcgtctggagaccgacggagtgagttcgcggatgcgcatgtcttgatgacattactggaatgaatcctagacgtgaagaagcctggacctcaattgagagaagatatacagtgatgatcaagccgaatggttttctatatacttccaagtgagccatttcagtgaacaattgagaccttcgtaggtttggggtaaatgctttttcagtttcatataacctagcttgtttgtgcactaattatttcaaaatggaagagaaataaaaagtcagacaaaattccactagtgtacaaagaatgcgtttttttattattcactttggatatctaatccatagaaacggctacactttgtctttaatcaccgctaaggattgccccattgatcccactactttccatctcgcgaggctgaatattactccgatcgtgacggggagttcgaatccctaatctacgattctaggtgtatctataaatcaagtacttgagtctgtagctccattccttctccgttgaagatgtttgtcatatcatgcacaatgcataccctttgtcaccctaaactggggatcatttacaagattctgaataatatttatacagaaattacgtaaagctgcttcagaatccaatctctttatctccaaaagcatacggctcgtcctttaaccatcgtttgctgtctacagtgtaccaaccaatcccatgagtttatcttacgagcatgcgtacaagacagggcagattagctacttgtagtatgcagactaggtataccggctcgtgcaggatatatcgtccacatgcgcacatgccgtacataaaattatctcacttccctgctaggggggttatgcgcacatccatccagttgtgaaattccactatatacttaacgctatttactgcctgaactatcggccatcctatctatacatagaataatgcttctcctgtctcaatctatgctcaacttgattcagaacccactccggatacacttcctccacggtcatggggttctcgtcgcgcaagactagttcctcatgcttcttctgctcgtccttggtcatgacaaccacattctgcaggttaatagggccctcctttctccatcgcgaaagcgacagtcgcgaacattcgcctgaaattacggacttgttcttgtatacctcctcgacaagatagccgacgtcggctgagtcaaaaggagccgcaattcgaataccgttttctccggttcgacgcttactttcccgagccagctggccaaccaaggtctgctgaatctggtcgtaggccttgggcttgtgtcggctttgagtgacaatgtattcaggaatgctggcgtaatccccgatagatgtaagcacatgggtggccatggagagtccaaaaatggcaggtagggagcccaggacaggcagaatccgcacacggtactggggtagaacggatagctcaccgacagttgtctcgttttcctcgttcttcttttcaaactcagaatcttccaagggaagcagtttggcttctcctggcttctcagtcgagaagatcacaggaataccttcgtagacaccgagctttcgaagcttgactcgagtggccttggaaaggggatcctcggcagtctgggagatgtcggcaatacggacttgggtgaaatcactcttgcatcccgcacccatggacgaaatgaccttgatatcacgggacttgcagaaatgcagcaggtccaccttggcgtcaatgttgtcgatgcagtccagcacccagtcgggcttgtcgccgttaacatagataagtcgttcggccatctcagtgtattcttgctcgctcttactcagcttggcaggcacccacaggtcctggacagcctcgatgttggcccaggggacgactccgctaaagtactgcttcacagactccaccttggggataccaacatgggctctgctggcggtggcatgtctgttaagagacgagagagtcacctggtcaaagtccaccaaccgcacgtttccaacaccagatcgaagcagcatggtagcggcccaagagcccactcctccagcacccacgataaccaccgaggactttcgaatcacctccagtccatcgtcaccgaagaacacacgggatcgcgcaagctgttcaagaatcagctcttcctgctcgtcgtcagagggagccaggaagggctttgaagcagatgtggatttcgacgctgactcagcaggtttttgtgttcgcacgtcgtcgtagaagttgggattgcattttgtaaaggtcagcacgcaggcggtcgccagcgaactgagtgcagccgccagagccaccgtggtccagccgggtttggacattatgtgatgtttggtgtacagatggcctgtgagctgatgttctgatctgtagtcatgcaggtttttttagagtttggagaccgcgcttgtgagtaggaggagtgttggaagagaaagaagagatatgaggtggctggggaggacatagaaggaaatacttgctttgactgattattagttgagattaagaagcatgccgagttttgtggtttgttaacgtgatactagtattatttctcatataactcgcttaataaacttggcataataatataaattgggtcgtataattcaggagattctcgtgcttcatttaatatactgtaataactgtggtatttccagaaatgtggtgttgtgttgtgaccagaccaccttcacctcaactgtcgacgatctatatctctaaataatcttatgagtcgagcaagtggatcaggagatggaaaataaccgtatgtgggtacgaaggcagtacatgcactgagttactcttggttgctctcggtaaacggtgatatatacagaagcggtttgggtacgagctcctcacctgtatcgtttgagtggagtctcagacggtccgactacaagtaggcaccttggttcgatctcgtatatatacaggctgacaatggcattattagggatttggggatgacaaaatagcgaggtgaagcttggtacttgtacagtacaagtacttttaatgtgagaacgctttgacagcctcgtgatcggtggatggagagctccatcgtattttttttgttgtcgacgctagtttagttctcattgtacattagtgccatcgtttgagcagctacacacttgtgtgtgtgtgtagaatataattttcatcaggggacaatagcctggttttccaaggattgggaccacgtataaaaccatgcagtcccaaatcaggtgtcgatcgcgggtatgtctcagggaactctgagtcttttgggttagtaggcgagctccgcttcttccttttcccttttgcttttggggacactgcactactttttgaactcagttgaaacggtcgacatggacggacataggatcacggccattatgcaaagcgtgggcagtgacgtgtggccgctccggctgtgcagaggctgaaaggcacatcgtggtggagggagagttcttccgggccatttcttgttggtccgagatgaagcaaatctccacgatacgggcttaggaggagcatagatgcaatttatgggtctgcaccacaaggctctgcttgtaggtatcttgtactgtagaccgtacgatacagttagttgaagtcatacaaatcacaaataattacaaccgtgcaagaaaccagttacactttggctagcgaagccctaacaaactggctccctcgatgatgtctcaagagtacagcaccgctgccgttcctgtgcctccaaggtagcgttaacgttgcgcagctccatcgtttgcagtctgcttgtctggtgtttgagcataaagctttgcagtacaatggacacgagacaataaaagtcaaagatgcgtggctgggaaccaggtggactgtggttcggtacgataccggcaccctaagtaatggcgccaagcgcaccaaagaaagacgttgtgtggtcttttctggatcccctgtgtggaccattgacacggctttggtaggtctttcggtggccacacgtcaacccaacatggcacgatgatcgtgatgtgggaacatgtcaacgtcagagctcagagacgtgattgtggactgatacggccctatgggtccttttgtgtgatgcagggccacttgataagcgcgagacaggctggaaatgaagcagtatcgtcttgccaacacgaacggaccgtttcgatgcagtacgacgacaaggtctgcgaatacgatgtatgaagaatgcggtaataacaatgtccgctccgggaagtaatagcaagagggtgagcagcgatatgtatagacgcgaaacgtggacaattgcaggcaattgcagtccgttgtgaccgagtgcaagcagttgcacctcttccatgttcactagtctactgtatctgacatctgcttgtttgttaattccaccggttaaccccatccagctcgatcttaaaggacacagttcggagtctcagcggtctcagcggaaaaagcaacgacctatagattgagcttgagttgagaagtgtttgactccgtcctgtccaacagaggagaagcagaaaaacacaaaagaggacaagacgaaaacctagtcgcactcacgaatacgtgcccacagagttggtcggtcacatgagatgctcataggaataaatgctgggaaattactctcagagatgagtaatacggcctttgaacaggagaagagacacagctggccccatccaatagtgacaggtgctctcagggctcaacccaatctcatgctactagctcttagccgggtctaagtggtgaggcagaagccactaatgctctcttggtagccactaaaggcggcgttagacaccgtcgagtagttatagctgttattatttatagtgggccggctttggccgattcggctggatcctcccatcgccggatccgagcgttgcaactgtacgcgggggataaataagcgacgcgacgctctctatttgtagcagataaaggcccgtgccagcatctccaacggccaactagtccaagtttaaccggaaaaaaagtaaaggtttacgtgcgtccgcacgagatgtgtttatatacgtttatacgtggtctagagcgcacttgacgagtgagctaaaagtctgtggtgttatagcccgctgttttggagcagttgtgagtgctacaggaatatgcttctgatggtgaacttcgtggagaagaagtacaagcacgtccaagtacgtgcagtagagtagagctacattcagtaagcacatacatgggcaaagagaagcaatacagatataccctgttcattgttgtgacacgtgaccgcgttttatttgtcgcgaacattaacccaaaccaaatctggcgtgacctagctggtagccgtttgaacatagcacctggacctgaaagagcacagatgtttgccgtaacgcattcctgcactgatgcgcatggaaggatgacagatctcagaaagatggagatggggttggagatgagaaacgaggttcagagcccctggcactaccctcctggttgggtacaaatgccttcagttatagctatgaaggagaaggcagcccaataatagataggtgaaattttgcaataggcagacacgctaagaataacggagctgacatctcagagaaacaacagtacacctggtcttcactcctattgttccttccaccgagaaaagtgagtttggggtgtatcacctttggttgctaccgcgcttggtcagggctcccaaccacccaaatctcttcagagagatgataaatacgaaatttatcagttatgggaaatataattccggaggttgagtgtggcacatggggccgcatggccaagaagacatgatttttaatgtctctctcttccctccccgaaattccctgcatgtttccccatcttgtttgctctcgatcgagtcttgtactgtatatatcatgtcccaccgggcaacgagatgtaaacccccaggctatacgaggacgtatagaaggagcatctggatcggagtttctcaaagcagcttttatgttttacctgaggtaaaaagactccataacacccggtcccatgtaaggcgagcttttcgcaggtaggccttgcattatgaaacgctgagtttatcccgagatgcgattttttgtgagggcgacaatatgcctaggcgtgagcatggccagtataagtagcggccgtttgtgcgagctggggttggagtgtgtaggtgaatgaggtggttcctgacgcttacttaaggcggagggagatggtgacactaatcgctagtctcagtgggcatcacgctaaccgtgaaccacactaggctagttgccgattaatggttttagttgtttttccatatatttgtctgttatacctgttgcgacaacttttggggtgaatctgagggcgttggatatcaaggtcgactgttggagaggggagtaaaaaaagacggccttcttttagaccgctggggagaagcgctagcacgtcagtgtcacatggatgggacatgaataatcaggtgccaaaaaaaaaaaaaaaaataggtggcgacaggcgggtaacagttcagaaatggtgctggagtaggatcataaacctcttttcaataaatttgtagctatacatagggtctagatcagggacgttataagacaaactactggtaggccctccgaacacgccggaggtttggattttacacagcaaactattggagctcttggagctaagcccgtggataatacaaggccgtcctttttattttgacaccactagcgcacactagtgtgagtggggtagtctggactacttgtagatagcggaagaccacaaagatagaagggaggaaatacatacatattctcatactcacgtctactttcagcccagctgtattaattaaataaccgtatacccatctgtctactcctgataacccatatccgtgcctgcgcgcgcgtactgtgatgtagcggcgccgtactggtacgacgacgtcggcttggggtagtacttcatgtactgattttgctgtgccgattgcgactgatccatgtagtagttgtatcctggttgcgccgagcccgtagcggccactgtagtggagtttgacggcgtgacgggcgttgtcaggccggaaaccacagctgtgttgttgacggtagccatcacctggcctacgcccgagtttgcaaaattcggtgatgcgctggtaggcaccatgggttcgccgtccttcttgtcgtacgtgtagtgactctggatgggagcgagtctctggggatagtagctctgtggctgggtcacgggcgtggtttgctggccattctggtatccgtacgggtagtagccgttgcccggagcaggaggtccggtctgtgaggggccctggactactgccgacgagccttgtagctgggggacgtgtccgtactgctgttcgatgagctttgccttcttttgctccttccacatgcgtcgcagctccttgaactcgctgggggcgcgcttggagccgtggccttgggccgcaacgtgcgcgttgagatggttgagggtgccataggccttggaacagccgtgccagttgcacacgtacaaacgctcaatctcgttgtacttgcgccttgggcgtttcgaatggtttttgttgagcggcagcagttggtggtaggggaacatcgttgtggaggtctggtttcgtttgcccgtgagccattgatatatatatatatctatatacatgaagctgcttataggatatagggaggtaggccaatatgaaattcaaactgcgatagagtaaacaaggcccaaagtgtagaaatcgtaaaatcattcgccaaaccacaaaaacaagcagagtttgcgtctacaaagcccacctcgaaccttgtcgagtcccatttgcaattctcaaaccctcgtctaaaaagtcagacacacaagcgtgaacctagttccgcaagcgagaaccgtaaccttgacacccactatttgtgcacaatggggcagtctgggcttcagaggggcgacaagcggagtattgcccaaagggtggcaatgacgtcggctttcgggctcgtccgacacacgcggtttcgcaaaaagactctccggaccttgtaaccactgaggtctccctctgttgcatgtccaacaaccagattatcgccactagcgtgggatggaaacgaaaaacgcaaaggtcatggcgaaaatcacaaaatgtaagcagaaaatagtcgtagaccacatattccgagatggcacctccgataacacaccgctctgagctacccacgtggtcacttttcgaaattccccagtcgagccaaacaaactaccgataaactgtgcaagagctacaactcgaagagaagagaagtacagtgggagaagataaacatcacgtgcaactcataaaagaatagccaccgataaattctaacttttttaatgaattatcaaggagacctacacttctgtgtggctctccctccctctcttctcttttctgggtctgctcgccgctgccgtcgttcgcaatgcttcccttttgcttttccttcgccacacattccaggttgcaattccctcacgcccattccattgaccgaggtgtcgggatacagtttatgtccggattgttcggaaaacggaactaggtcgtatagcgcagtgttgtgtaaccgcagtgttcaacaaagcgacagtgtcgtacgtgctgccacttaatacgcagcctgtgtgcaaggtcgcgcagattacctactggaagaccccccactcgttcaagaactgacgggaaggcagaagatgtctctcggctgaccccccaacttcggcgataacataatgatcgtatattcgttataacactagtctacactaaactagccccttcggctacactcgcataacttgccccgactaattacaagaccagcggcagagagtatcctccatcgacgtagccggctcggataaacgtcggacgtcggcccactaccgattgaatgtaatcaacgtccactccttcgtccatgcctgaggccgaaagcaccacgacgtcatctaccatcagcgaaggcgtgtagattccaggcccaggtggggggccccaagtcagctcactatccaccagcattagttcaatgtcctggttgactactgagccccgagctagcgccgagggggattctagggtcgaatcaaagccccagcgacccactccgttcacgtatagacctaccaagaggccctggtagagcaaaccgagatgggtgtatgtagatgctcccgtaaccagtaccaagccgatgatgtaatggtggatccgcagctccaagttgttcagggcgcctaccagacccaaccccaccaacagaagcactagagagatgtagaccacaatatagcgctggaatagcccagctcgccaaatgaggtaggtttgcgaggcgatagcagctataatgatgatcacaaacacaatgaccacaatccagccctcgggccgtgcgtttagatcgctcaccatcagtctatccacgggaagattggcgaaggtgtagttctcaagcactccacaccacaatccagagttccagagcagcaatcgtgagagggagggtgttcccagcgatcggggcactttctcgaaggtcttgaacaacgagtcaccattctccagatccgagtcgtcattctcgtcgacttcgtcttcgtctcctccatcaacatgaccggagctaacagactccacgttagcgtagccatcgtctcctcctggagttcgagcggggttctcgtcggttccaatcatgttcttgacggcagctctataaataatgtatcctccgagcacagcaggcagaagtcgctccacagccatactcagccagaactcgcggactgcgaggctggtggggcctgcccctcgagaaaagtcgacaatggggtcggcaaccatgaccagaacccagaaggatacaaggaactgcacccagtagaagccagcgacattgacacaaaagtagccgaaaatgaaggacatgatcacacaaaaggccacaatggaaatgcggttgtctttacctccgctcacgtgatcctcgtgcacggagaaggaagcggggaacggcgcatcaaagtctatactgtcaatggtgtaggcccccttcgagcccatgaaagagtctctagggccctcgaaacgaagtcgaaacgttccccccgtgtatggtgatacgagtcccgcatgcagagccgctgcgcaggggcttgagtcggcccggtagtatctgttggtagcttcctcctccttcgtctgtcgtttgaagaatccgcccacgtgcagatcgctctcttcgtagtcctcctgctcgtcttcctgcacgtcggtttctttttcgaggccgcctccgatcacgtaggggcggtattgcaccgattgcatgcccaccagggtttctccccatttccaggagcccctgacgcatcccacggggcacttgagacgcatttctcttctcgtcccgtctggcagcggctcgaacggcggtagacagcccgtggcgttgactccacagtcgggcttccacacgtgccagttttccgcacaccccgacaagctggtgtcttctggaacccgccaaaaagactgtgagaagagagataacgcaatgagccaccagagggcgacaaaggcgaccatggcggccgaccaaatggttctgcgctgttcattgcgctgtaatttgggtccgtcgcgcaatcgtagaggccagagctgagcggatttgcaccacagggtaacgtttgggttgacgggaggtgatgggccgtatgtccatttgggccagctcagtcgcaacattgtgggtgtcgttggaggtcagtatgtcgaacgaatgtgcgggagacctgacaaatggcacaactaaagctaccaggaggccagctacctttgattttaaaatatagcatttttgggctctttcaagccttcacagaagagtgctgctcatctgcagacgtgagagttaaattgcagagtgtgccaagtgttggaaggagctgtgcccacagatacaataaagagagggcgataatgggttcattttggcggtcacagaccctccagtccaggtttcgagctacctgtgaccgtctagcagaccccgatcgtgcacgagtttatctgatcacatttcccggattatgcaccacctgcatttttccgaaaagacctcggaatccgttgtgactagggctaatgcaacgaaatgccatagttgcggatgagacagagaaatagttagaaaagagagaaaaggcgcccaaatgaggagaccatatgtgcggtcccaaagacggcaaaactgacgcgcacgctttggactgcgcaacatttcctggtcttctatgtatgacacacgtgatattgctatggatgcgattctaacatgtcggcgccagccatagctattaatcacaatcagattgcgacagcggggggggctcacttttgccgttttgtctaactataatcggttgtcaaaatgcgaaacccccaaatgcctcagctcctcccttgaaccttcttggcacgttcacctcctattgtaggtcccacgcgatgtggggtcgctatgtataggtataggtggggagaggctagcaccggactggacgcccggttatatagtctccgggcgtctgtgtccaccacagcacttttgtgagctgctttaaaactcagcgacaaaaccagacttgcgcacaagtacctatgagtagctacaagtagtggtagtggctacaaatagtcgcacttggcatgtcatcatcagtcacggccgtcgtccacagttttgtccaaattagttgtagagagagcggaaagagcatccaagtacagtgcggtagcagcatttccccacagtcaacagaaccagtgtcagggaagagctgaatttcgcatgctctttctgtattggatgttgctggaatgcagagaggcatacggataataatttccaggttattgaggcgtttgggacagaagtcgatgggtgaaattagccacagttggtagagagccttgcccgccctggtactcgtattttgtgccgtagccacagttgagtacataccacccagactagcgcacattcacgtctacacatcctcaatgacgtaacccaggcatggattaaatcaagctccaggtggctattttggttaaaactggaccaaagccatttgaaggggcaccaaagggctattgtacgatactcaaaattacaccttgtttatgtgtatttggattaacgtgtgccgccgtgtgtgtacatgccagacccatggaagtatgacatcatatcacaacagacagggcacacacacgcacgcaccggcttactaataccatcgactcatacatgaaattcatatctctgcacccaactgcaacccggtgacctccctctcccatcggatctataagctgttccgaagatccgatttcttccgaaggtttcagaaggtcaaaaataggttgcgtgttgccttagaattccaggtccagatttacgcacgactacagtgattatgccggtgaacgtcctaaaatatcgggcctgtcagaccgcgcacaagtccgatttgcaatcgcaggagaatctccgtctctaccacatgactgcgtctgtatataccctcgtgctatctctgaccatacaataagcatcttttatggtcacttttatgctgcaaattttaccgccaagaaagctgcattcattcagtcagctcaccgataggatgcgaaatgctgcgaaatgctgcgaaatactgcgaaaacatgctggctagaggtatcccgaggcagtaaaagccgctggccaggccaggtccatattatcaatgactaattagcgtggcaacgtgttactacaagaagtagtatcagcaatatatcgagtacaagggtctcgcacccaccaatgttctcacgtgattagccctagcccaatggaccatccccacaagtaagcacagtagtgcagtgtcaatccaatgacgcgtgttttagtctccactaagtggggaagctgatagcacgccgctacgcccatttcccggccaaaatcccttttcagggacttttggcaacccctctctctcaatcattccactacggaaagagcaggcgcacatgtctgctgtgctgtacgttaatttgggctggtggggttgtggatccagcatcacttgttggcccaaacgcaaagggtggttgggaggcaagataacagagatggaggcttgtcggagggcataaaagacactaaaaaggtgatactagtctatgctaacgcactccacctctcgcagtagagctgctgcaccgtgtaggggtctacgtgggcactttgggtccgtcgccactgaagacagcacagggttcttcgggacctgaccttgtcgctgacatttgctattacaggtttttcttcttgcaccttttaaactccaaacgctttttcaaccttaaccacctcgatgcacgcgagtcaaacaaagcctgcgccggaggacatagctcctcaacaagtgccataatgtgaggggaagttggctgttcggaatcggcgggcccgaaaataggctggccaactgtcccgaaccccagagtatgggaaacacgggttttagagcgcagccatagacgtggtttatgcaccttctgaacgctaacgccgaaaccatgagacaagatgccctggaaaactttgctgagcctggtatatatgtcgagagcgtgccaggtgcatggaaaacaacacgtttgcaccatgaccgaagaaaaaacgcattcgctgtcgcccaatgactctgtcagcagcggcattggcgagatcaagaccacctccaagtggcgtaactttgtcgattccttcaaggaggccgacctccacgatgtcgacaccgagggcatgaccgagctcgaaatctcgcagctcaaggccgctaactcgcccctgcagcggtccctcaaggacagacacgtcaagatgattgccattggaggttccattggaaccggtttgtttgtgggatcgggaggagctctggcccagggtggacccgccgccctgctcattgcatacactcttgtcggttctcttctcttctgcacaatcaactctctcggagagcttgctgtcgcgttccctgtctcaggagcctttgctaccttttcgtccaactttattgaccctgcctggggttttgccatgggctggaactacactctcaactggtttatcactttccctctcgaactagtcgccgcgtctattaccgtcgacctgtggcgtgaatttaacaattccaacatctcgcctgcagcctgggttgccatcttctatgtggcgattgtgtccatcaacttctttggcgccaagggctacggagaggccgagttcattttctccatcatcaaggttgtagccgtggtcggattcattctgttctctctcattctcgtctgcggaggagtccctggaaacggatatattggaggtaagcacttccacgaccccggtgcctttgcaaacagcttcaagggtgtggctgccaccttcatcaatgcagccttcgcgtttggaggaactgagctggtcggtctagctgctgccgagactgagaacccccgacgagccatcccctctgccaccaagcaggtcttctggcgatgtttcatcttctacttcctgtctttgcttttcatcggccttattgtgccctacaattctcccgagctgcttgctcagggctctgttctgggctctgcctctccctttgtcattgctatcaagaacgctggtgtcaagggactgccctccgtcatgaacgtggtcatcatggtcgccgttttgtctgtcggaaactccgctatctacggctgctctcgaaccgtggctgctctggctgcccagggaatggcccccaagatttttggctacattgatcgaaccggccgacctcttgtgggtatcattgcctgctccatctttggtctgttggcctttgtctgtgccgcccccaaggaggttgagaacgaggtcttcttctggcttctgtcggtcgcaggtctgtctggaaccttcacctggggctccgtcaacctgtgccatatccgatggcgactggccatcaagaagcagggccgagagctcaagcgagaagtcaccttcaagtcgcgagtcggcatctggggctccatctactcctttgttttctgcattgtcattctggccttccagttctgggtggctctcttccccgttggaggagccgaccctactccccgggtcttcttccaggcctatctgtgtgtgcctgtcattctcgttttctactttgtttacaagatctggaagcgaactaagatctggaagctcgcggacatcaacctcgacgtgggccgacgggagttcgactacgacgccttgcagcgacagctggaggccgagaaaatcgagatggctacccgaccctggtacgtgcgatggggcaactactggtgctaaacggtttatggaggaagcaaccttgtgtcatggcctccctccacattatcaagcaacaacttattatgagcacactaagaatgtccgagagcgtttggactttatattgccgcttgtctcttgtcgatatcttagtccctgcttttctcctctgtacgagatgagtccgtcctaaatgtaggacaggccaagggccacgagggtcatgaatgaccgtgagtccgtacagaacagtacgtagagtaatattatttatttgtatgacgttacgtttggcgagtgttttacacgaaaatagtacgagcaagtaggtttctatacgacgaactttgtctgacatgtttgtgcgtgcaacacaactccgcgacacacaaggctacaacgcccaaaggtcgtaaatttgctctcacaagctagcactccttgtatgtacaagatttctgccaattccagagcgcatatatgatgttcatggcgaatcaaaggccgaggtcaagcaactctatatggaagcttaaccaagaaactactgtattctatttttagtctaacaaacacgcatcgacattacatgcttcagaagaaggacgtggtttgatagacgagcgattgtggatgacgtcagaggatcatgggttgatttgtgtcaattggcctcaattggtctcaatttgtcaatttgtgtcaattgtttgttttctgtacatacttgtattgcttctctccatggtatagtcctaatctcaattcctctcgctgtctcttctaaaagcacacgacacacacagcattgatgcatttttctgttggagaggggtaacgttggggaccgacctttttgtcacaacccgacatggcaaacccgctttcgacactcgcgtcactctttgtttccactcaacagctccatctcggatcgcttcctacagtacatacgatacatgtctctgtatctcgtttgtgtaaattagccgacattaccatgttgtagctacatcccatcatcttaggaacagtactaactactggtagacctggtccaatgtggatattagttctggcgttatcgcaagctctagatatgcaaaaaaagtgaatcttcttgtctcggttagctcggttggtggggtgagaattatattagacacggtactgtagcttggttagcaggctagtggtagactggctaatttagactggtttctaaacccgagtctagaacacgtttttagacgatgcatatatagcgaaagtcgctatggccaagtattaacgtcacgtgaataggtggggtccttgtgtggggtctctgggtggctctggtgcttgttcttgaacctttgtatatgccgaacatgtatagatcggacttatatttctcccaggcaagtggatcctgctcgcccacagcttctccgttaactccatctgctcctcactcctaaggtgttcaggaacaggactactgatagtacgcacaccatccccttggcgtggtgtattcatcgtgttatagatgtaagagcttggtaccggtagtaggcataagggcattagtagtggttgcggtctggcgactcttgaggccgccaactctttctgaatcctcttgaacagagacgatattatgtgttcattattgccgtcgtggtaattccactaatagttgtgaggttcgtgtctccccccataagagaaggaaaggagaataatattccaactatcccttccagagaagaaatgtttgcacaagtcgcttccccgcccgtgctagtctggctcattattatccatttcacgcctgctataattgttcaacggtggctaaagttgcccactatatgtcagagtgtgcgacagctatcttaatggcttctttttggacttggtgggaagccagacaccaatctatactacagtatgattaactggagaggcttcttgcggagtaactggtaccgacactgtatagatcagccagctatgaggagtcatatgatatcatagtctcacacacgataataaaaaaccacaaagaacgaatcaaaagaatcacgggctcataaactagtccagtttactcattacccattggctaatcttgcattgtcaatattagttgtttgctcacttagtgcttctcttgttatccccacatactatgggttagggggaggagagcgggttagcctggtatcacgtgataataggccggtgacttggaaatataacttcatggggtatcttagaaccattagttagtcggcatgatccccacagtccacggcagaatgaataaacctccaacaagaccaaacaagagtgtttatgctatgcatccctattccataagagcgggctttgtctaagagttccgaatgaagacccaaaagtacgacatgaatgttatctccacattattccgattcgtgggtcaataatattccccacattttcttctttatcttgctgtttgttggttgccgaaagggctgcttcagcagttgctaaaaacggttgataacttctagaccctgactactgcattcccaacctccaaactgcaccagtagtggcgagatatcatcatatgacttttcggatccattccgaaagtctagatgagtccaattgaggctgacagccgtcagacgtcttgctcatgctttgaaatgatgcaaaacatctacagacaagaggcggatgacggggatataataacaaagagaggaagagacaaggactagtgtgttgtagagtgtagatagtgtatattctagtcgcacaaactgtccttgatcattgacagctcaagagcaacactacaagtaggcttgtttgtttcagtacttgtagcgatttcaggtggcacgaagcacacaagggggtgttcggcaaacaagaagcaacccaggtgaagacacgcgccttgtagtgcgaacaagttgggctttttttttgaacggcttgctctctgctgtggcttgggtataaaacgtcacattgccatacgtcattcgctatgtctagttaacgttccgtcaatctgtgctgcgacgtcaaaagtgacaagatgcaaccgtcgacgtcaaattcaccgattggctgtttccttttttgggcgaaaccaaaggttccgtcaaccgacgacgcaagggactgtcatggttccgtagtaatagataacataacaagggcgagctaacgagaggggttagccagatgtggttgactgaggaagacagaagcgtgcgtacgactgctagtgtgatacctagagagacaagagatatgtgcaggaacaagaacaagacggccctttgcttgtcctgctgtcctctcgtcttggttatctgtgtttgagctcgttgtagacactcctgcatgtataattagtcgaattggcacactagtgtccagacaaacgtctttgtttttgtttttttgtcaagcggttattcttgcctggaaggtgtggcaaacccggcgaccaaatcgttgacatttcctgatctccacgtgttatggtccgactgagagaccaaccgcagcccggaaaaccacaccccaatcctgagccaaccgaagatccagcaacgttgagctagcagcacactacttgtagacactagccacccatcagtgaaatgccatgctacagtgtgcaatacatacgtgacagtcaggtgaagacaaccaaaacgcggttggcccaccatgtccgatgaccatactgggtgggagggcagtcaaggtggaggattgtgagggtttgatgaggtcatacaaaactgccatatgtcaagcggactccgttccacgctctcggtctaagcagtagacgccgttatgcacaggatacagtagcttcccaccactgtggtggttgttgtggctgacagccatgtcatgtccatttagctgctgtacagtgtagagtaatagggattacatactcgtacaagtacaagtacttgaagattggattgttgtgaggatcgaaagggggtgctttttcccgcgctcttcaagagacaaggagtatcataattcaccgggtatgtttgtcattcttcacatctgtgtatcaaggtcagaatctcatcgaggaatcgaactgcgaggtggctatgatacttttacgagaaaccatgcatatacgcatataggcataattatggttacccggcccaacacaagggtctccagaatcgcggatattcttgttctacacgtgggaacggagctgtatgccaatggtgctatgagacacacaccaatgaagagcctgctccaacccaccctctattgaatggtgtgtacggcactctcattccacataattctgttaggctaagcttgtttgggaccatccatgacttgacgtatagcctctgaatataatttaattttagggcgatttcaactcaatatattctgaataatcagggaaaatggaaataacctggaataaacgagactggacgtaaaaaagacatcagaagcacgtctgttacaagagcagtctaaatgatgtccagtcactcccaaatacaagtagctgaaacaggtaatgtctcaagttgtttgcggggttcgctccgtggagctgcagatctccaagcgcagatatgtgaaatatgcgtggaaagtgtttgaagacgctgatcatagaagccatttactgtacgaaccaatgcagttacaaggctcccaactacccgtacttgtaccaggtaagtagcctaataatccaggtctcaccatggggtctcactatacagtccacgggtgtacattcctctctttagacagaaacagacaagacatgaaataggtggacatgagacactcgagaatgtaggtttgagatacatcccgagcaagccgataagccgaagatggtacgagacgacggggttcttaccggtacagtgcggttacttgtaatttcaatttcaattgagttgcaataacggggaatgagaagatacatggagtcggattgaactgtacatacgatacaggtacgaatacttatattgtactcgtaccgcacttgtatgagacattaatttgtacttatgccagtggttcataagatgtttctaaagataatcgcggggttatttatctcactgaggactggtacagttaactccacttattcagctacacgatctttctccgtagcatcttcaaaggtccttacaaatctacctcgtcatatttatatcttatatattcgattttcgattgggtataacagttgctccgctgtagctcattactgtctgctgctggcgatcagacgtgcgtaaattgatttttagaagttaaaaggcgttctgtaattcaagtctgccgtctagccctagttcttcggacttgtgtctccagcaacccctattttctccaatacatgacctgcctctacgtcattatctctcccatgctgtaccaggcgcacgcctcttccccgcaccgagttaaagtggacgatgaaagttctgcagatcaaaggtagatgagagattgctgtgagggcaggggcttggatagtggagaaatgacgaaaataattggttaaatcaaatcccctcaccaaggcgaacacagtcaatattttaaaaccccccaaagccgtcggtatcatcctatacttgacgacatcttttctgagaggggcgggttgcagtaatataggcgtttttaaaagccttttttccttcttctgcgtctctacagtgcggcctcttaattggaggcgcaaaacggctctttgcccagggtcatttggatggtgggggacgttgctaattagggctcttctgcgcacgccgtttaaacacgttcaacagagacaggtgggcaggcacgtcaggcacatacggctgtgtcagattgtcgagattgggtcctagacaggcactaaaacttggctgatggcagctgtgggccgctacgaaacggaaaatcgggcattaataatcatcaaagcgccggaggccaatatctattccgtttcggtaggattttcattgcagagtggcagtatcatgtagggtgtaaaaagtaaaggtgctggagggaaagggtaaaaaagcacgtatccacgagggctgtgcatactatgtcgatctgttgcgtaattggtcgtcgtctgtggaggtgtgtgcgagtggttgttcttagggaggtatttgctattatcgtcgtttacttgcctcgttaaaagcacgtttgacgcactattcctctctgtttattatcaaatatgtgcagtccgaacatgggtcttgcgcaccttgtcgtttcgtagttctttacgcgacataatgggagtctatgagatgtgagggaaatgctacatggccaggtccactagtcagattcgaaagaataggaaccggagcacacgatttggccattgcaactaccagcacctggcccacccttatatatcctcccgttcctctatcttcctagttccattcctgttgctaccactaaaaccgactttccagcgtcagcgtctcgttctaggctcccaaaaccttgtctcctgcccctcaaccaaaacaaaccaaggtttagaccccggtatggaggtggggtgtgggtgtgcaaagtaggtgaaggagatgtctgattcgtaagagaaacccggattcaaacccgtcgcgttgccagctcctccaacatgtcctcttccacccatcgcacggctatatccgctaagaaactgggtccacttatgcaccccacttgtctctctttgcagcttttggactgctcgccaaactatgtttcaggtggcatgagcatatctggaagtgtatagtatcgggaatagacactgcgagcacgacaatcggccctaaaagcgctatggccgaagagtacacgctgtcgacaccgtatcttctccaccgacctccgatcgctcatctccatgctccccacacgctgatcatttaaagtctgttttcttttcgctagcttcgactgtgcatccctcaacaaggttaaggtcacgacaggcctgcgactcgataaacgtcttataagggtggtgtcgccggattgtcagatattggaggttgaggaaggaaagaacgacacggaacaccgacagattcagctgctgccgatagattggattcgcgaccaaactacctcgacacaaagacgcgtcacaacttccaccagatacactacattccatcagatacacactacattccattccagacaccgctacagccgatatagccgtcgccgtctcgtgttggtgataatttctccgcgatttctctcactttttttgcattctctcacttaatctcacacaataccagccatgtcgacagcccaactgtcgccgttagagcagttgctggcgctgctgccaaaactgtttgagggaaacggaaacctcgccacagtcacgtcgctgctaccttcaggtctactagaaacagtgctcaactcgccctatggccccgctctcgtcgatattctcaactcacagacaggcaaccggccactcgagtactcagatagattgctctcgatcatgccgatcccacgatgggcatggacaggaaccggagtcgccaaggtggtcaaaatggcccaccaagttgtgggaaatgaacttcccgtcaatgtcgtcaacctcgtcatgaccacgcaatacaatatttacggtaacttccccaccaaaagcgatattgcaccctcagccattttcgtggcagtcaacggcatcctcatgtgcgcccacttttatgtgtttgcccgaggttacatgcgaaaccaccacttctggccctccttcggcctaggatggcactgcattctcaacatgctgggttttggcatgcgaatcggctgggccaaaaatgtgcttgacattaagctcggtatcgcgtccacggtcatgattgttgtttctattgtctacgtcaacgctatgaacctgctgctagcacaccgaattctcacatttagacatcctgaaacgggtgatgccacgtggttcggttgggccatgattggcgtctaccttgtcattatcggagtcattgttatggccgtcatttcgcaagttgttatcttcctctactttttgaactaccaaaactggagacaggccacaggagccatgcaagcatcttccgtgtttgcaacactggtcgccataggaggagtatttctcattggtctggcatacgttcttccccgaggagccctttctctccataacgacgaccgacggcgtctcccagcttcaaacattgagtcttacggcatgttctacttccctcccaagtactcgcaggtgctgcagtatgaggcagatcccagtgccaaaattgattctggcaagctggctgctcgtgtgttgaacggacgagatcttggctcctctgccgccatcattattatcacttctctgattcttaccaccacagctgccatgcgatgtgctacctgtttcctgggtgagcgatggtcactcaacgtggcacccatctacagtaacactctattctacattggtttcggactgtttgagactattgccaacgtcatcttcctcgtggttcgaatcgatctgcgattctacattcccgactggcctatcaagggcactggtcctctgaccatcaaacccggcactatggagattatgaccgatccgtaccgacagggtcctcctggtatgggtcccgatgagaaacacttcgagaaggctcatttcgaggaggtccaacctccaatgcctcccatgcccacctatggagcaagctacggacccatttcgtacgctggtctgtccccagaggtgctggcagctgctaacgccatgaataccacacctggagctattcagcaaaccgaggaggaagctgagcgagctgctgagaaggccgctaacccccacactcccttctccgaggctaccaagctgcctacggactctgagtttgtggatcccatccctccaatgcccgaaaagaagctgaagcattctcccgagctcagagaggctactcttcctcagcttgtgaatctgggaagtgcgcctggaacccccaacgctgcggctgccacctttggagagatcccccacgccactccgatgtccatgcccacagtgtcgcagactcccatgcccaccttacctaccattaccacagcccacgagcccagtttcgcacagctccaacgagagcgactggacgccactccttctctgcccgagatttctttcccccctaccccttaccagattcgagctgttaccccagcagcgttccccacacccatcatttctcctgccactccccagcagttccccgaggctcacttttctcgagtcacgacgcccatggagcgtggtttcacgcctgttacacgtggattcactcctaagcaggatctcaatgagcctacttacggcgtgccctacgctgagcgggtgagcatcccctcaccggtgcacgattacgatcctcattacagcaagccttatgaggagcctaaggacgagttccgaaacagcgggggcagtgaggaggtttaggcaatgagggagactcactaaaacatatttattggatcatgatccactacttgtagctttcttgtattttaattttatgacttttgtttatcacttgacgcgacccaagccagaatccccaacctcgctggtgcttgactacgtactcagcctcattggatccatgctacgagtagacctcttccgcggaaaaaatgtacaatcgcagtatggaaaatgtatgttcatacaagtgcccataattatttgcagggtgattgaaggagggttatgaaggagacaacatatttattaatgctggagtggagtaggggggttcttcggcaagcactatatagcaacaatcattcttcgcttctggaagctcttcatacttgtgcacagagtggttttacgactggccaaacacacaaacgcatcaagctcctacaaactgtactcgtactggtactaaccagtaaagacaggtctactgtacgataagataggacggacaaggacgtcgtttacgtcatgacagcattcatagttgacattagttacaaggctaactaaccgtgtttaatttcaagcctaaacacgttaggttgaccctaagtccggaaatagcgagtagtcgggattcttgatcctcagacatagaaggaggtctgctgttgatcctgcggggtaataagagatggaccttaggaggggcggcgtttctcctcgccaaccagtcctggatcacgttctaacccccctcatgggtgcacaatggtatgtttgtgcgcaaactcttttttacattccaaatctcaatctggcactaaaagagagttcctcactgggtcagcgtcaagacaagtttaaaatcagtggcaatatgagaacaatgacagttcaagggaaacaacatccggaagacaaagcattgtagagtgtatgtgggtaaacacgcgccagttttcgtgctgcgagagccgcgtgagattgtggtatctacggcctcctccctctatgtccgaaaaatacgccccaaagaggaatatcctgatgaagaaggtgcttgtctgagtctggggtaattatggtacaggggtgcagccaataccaatcaatctgacagagacaaggctaagactcacactacagcatactaccgtagtttctcggaacatggaccgagtctacttaagtcgcacactagccagctgtcagtccattccactttagcgccgtggtaaagtcaaaactgactcaaacccgattcaaactcgctccgcattagttttctcttagttcgtggtacagaacttgtagatggttatttgtatgctcgtgtgagggtaagatatgggctttagcaaagattagatttcaagttcttgtacacacacacaacttcttgatcaagtcattacccgattcctgtacgcgtacttgtcgctgtttcgtcgttacagacctcgtaaaacagtctcattgtaccgactgacaagcactaacacgatggctaattgcacgtcaatctagaaagcctgtagcttggactaaaccgagctttagatacaagcacactagtttagcctggcttgggcactaggagacataatatcgctacaaaatgcctgccggcggtgttttgcgcaaaaacgtccgaactccgacctaacaaacaagaggtcggaaacgaaaaagagtgagcgaccacaatgattattgaagcatgacaaacaagaccccggaggttgcaacttccggctggctgggcttctgacaccagtgtcatatgcaagccatatagatgttcaaaaagactgtcaaagtaagccgatgcaatgcactgttactctgtcataagtcaacacactcgctagatccacgaatacagatgagctgagctctccattgtgcatgatgagtgcatttaatcgtcagagaaatcaagtaaattgtacaagtagcggatgttgggccattgacattgcttgcctggagcacgttgccgtattcgttaggcggtcctctggtagctaactatcggtaaactggcattttcatggaaatatttttcgatctactgtacagatagtgatacatactgtagctttctgtttagctggcaaattaggagacaagttaaaaaagatcctcaagcaactatagcaagtaccatttcccaaataattcaaggacttattgttaaagtggagggtggtttggtggttagatgttacagtagagcggacccaagatgaaacacgacgactttctggattgtgtgaactatagtatgatttttacataatgtatgtatgtatcgtaccagtatagtaaatatatacttatacttgtctcggcagatgcacttgcaatgagctacaatgtgctctgggctgcagtggtaaactacaagtagtgaacgcgaactactgaggagttcaaacccccgatcttacacactcgttcgagtcacatgactgactctcacaagaccaacaaactcctaacctctcaccgatgtgccactaatttttttactcatagaaggctgggagaagagtcgtagaaggctcgtattttaattgtaaggtgtaacggggcaagtagggttaatagccgtagtattaaactcaaccgatatactggtagctccgaagagtaaccgaacatacgaaatatatcgtctcagaattgcagactatacaccggaaatctctcagtactcacaacgcaaccattacaaccttggaccaaagtcacatgatcacacaacgccacactagcgttcccgagctagcttagatgcatgggtatcggtgatctaacggtgttcgacaagattattcattacgctgtcctataagacagcagtattgcaggattcacttgacttcactcccacaagaaaacaacgacaactccgactgcggatataccgcaaagcgctaaaagcaggtccctgactcattcgtatgtccgcagggtgcatgtgtgagtaagtaatctataggacttgttattgtacaacaatcgactttgaaataggggatatgcacaacaacggagattgaaaatttatcaacaacgaaacatgataaatcgaatgaacgatatccgatatcgatatctcctctattttgtcgtcaaatatcccattttcttccccggctaccgacggccaactctaactctatgagcactgaaaaatcctacttaatcagagtcttcccaaactcaccttgcacacaatatacacacaaaaatgaccaaactgtcacccctcaaagctgaccgactcgagatcactctcaacaagtctcccaagcagtttgactctcccaaggacctcgctcccaactcttccacagactacatcctccaggtcgactacaccgatgaggctggatgggatgcccccaagattgggccctttggtcctcttcagattgatcccaccgcctctgttcttcactacgctgtcgagtgcttcgagggtctcaagctgtacaagaacaaggctggcaacaagctgattctgttccgacccgagctcaacatggctcgtctcaacgactcttgtgagcgaatcggtctcccccgatttgacgaggccgagctcctcaagtgccttattgagtacgtcaagctcgagggccgattcgtcgcccccggtggcttcatctacctgcgacccactgctatcggcaccaacggcggtctgggactcaaggcccccactgccgccaaggtttttgtctgtgccaccatgatgcaggcttggaatgccgagcccctcaagctctactgctccgatcccaaggatgctgtgcgagcatggcccggaggatttggctacgccaagctgggagccaactatggacccactctccaggagaactccaaggccgttggagccggctaccaccaggttctgtggctctacgacgaggacaagaagaccgtcactgaggccggtggctccaacttcttcgtcgccatcaagaagaaggactccgatgagatcgagctcatgacctgccccatctcaaccaagctcatcctgcccggtatctctcgacgatccgctctcgagtacctcggtgagaagcacaagggctccaacgtgaccgtccacgagcgagagttcggaatcgacgagattgccgaggccgccaaggagaatcgactcgttgaggcctttgccatcggtaccgccttcttcgtcgcacccgtccagctcatccgaacccctgagggcgagctcatcaacgtgcccctgtcccagggcgactccggtgactttgctgccgacgtcaaggccaagctcacctccattatgtacggagaggaggagaacgactgggccaccaccgtggactgctaatccagtcagcaatgtcctacttgtagcatatgtgaatagaattatgatgattatacctagaaaaaaaaataagtacttgtagtctagtaaaggaatgacaggaacttgaagtgccaactacatgtacaagtaccgggtagataatctaggggtaaataccactccgactgtacaagtacattataaactaccagtagcggtagatgttccaatggttacacatgtacacagtatgtacactcgtatcgacatctcaagtacccacacataacataaagaatcaatagtaaagtgatggacatagcggaagatagacatacaaatacccgaaagatcacatatgtcctcagaaattctgattggacaacattaggttatatcgcatagatttcatgacatagatctcattttcgaacatgctgtatcgaggcgtgatagaaacagcgttacccagagcaatcgagataattaagaaacagatcaacaacaaactaatctcctgttcaagtcgcatgcacttgatacttctgttttaggcatttttttggtgagtaaatgatattctgttgcacacttgccatgcaaaatttgagaagctctatagatcccaaaacaagggaaatatacctaaaacagacaaatacgcactatcgatacattataaaccggtggggtacatgtatgttgctacaagatctcgaataactcgatttttttcgaaagagcggaattccgatagtacactttaagtgtcctgttttattaaaatccgcaatagtttagtggctagaatttccgcctgtcagaacagttgttcagcacgcgggggaccggagttcaattctccgttgcggaggtttggttacggccatatcctggtgaaaatacggcttcccgtccgatcagccatagtcaagcaccagagagcctagttagtattgtagtgggagaccatacgagaatcctgggtgctgtaatctttttgcagagcttgcgttggtggtccgccaacgtggctatcacttggataatttttagtatctacatgaccaattatctgctcgtcgtacatcaaccatttgacaattaaaaaaatatcattgatctatcaattcattattcgtccttccaacaacccaacaactaagctcttgaatctctatgtactcgtattggcatccccagcggctggctcagccttggtcttgtccttcttcttggactccttctctcgaggtttcttcagtcggtaactgtagtcatctccgttcttggtgatgtacctaacccatggcaacgacctgtacttgagagtaggctcgttgaccttgagatatcgcacttgcaggcctgacatggcatagtaaggaatctcgaaggtaacctggacggggatctggctctgtggagtgttattaagatgcagcaactctgacaaagactctccctgctcctccgtgcgcgaaacagagatctcggccttcatggaaaactcctttcctcctccctggagctgtttgatcttccatcggatggcgttacgctcgggcatgtagaccacggttccggcagtggctctgaaacgtggtgaagtggcatctggaggcacaggaacaaacacttctacatcgttggctgttgaacgttttctgaactgcgacttgagcttaacagaaatcagaagacgcgtgtttcccttcttctcaacatctgtggttaccagaatcagtggccggtttctggcagcgtagtttcgcaccttttggccctcctcttcttcagcatgatcttcttccgcgttggccaggttgagtcggtagctcatgagctcgaacttgccgtctggaggaataaaggaaatctggcggtcgacgttaaacttggacaattcgacgcactggtggaaccgcacgtcttccatctccacagtttttgagcgcggctttttatgtgtagtggctccagtggcagccaacttgtgttccagcatggccttttcattgagtcccagacgtagctcaggcattccggataaataggaggtgacgttgattcggccctgaatctcgtgtcgaaccactttgtcgttagcatagagcagattgacgctttcaacaacgtccaaaaacagttcgtttttcttatactgcagaccggtcggtcgccacgagattctactggttgtgtgtgttgccacgtcgatgtctcccgaatttccggctgctccttcctcgcccacagcggcattgaccagatctcccacggctcccagtaagcttttgtgagcgtccacagtgatgtactccttgagaatgcccgcgtctgtgatctggggcactccaaagtccatcatttcgtcgagcagctcgtagatgagcacaaagttgtcctggaccgattcggcatgcaattgttcgaaatatgaggtcagaacggtggctaattgcgatagaaagaccagagtctccatagagttgcagctcacctggggactcacggccacgaagataactgagccactttccatccacatgtagtggatacctctgtcttcgagaacaggaggggccacattgccattctgttgagcgatctgaatgagcccaggaagatcagaaatacaactgagaggcacgtctccccggtagtttcggctcagaagcggcttgaatgacggatccaagatgaacaaggccgagatcatggtgatgttgatgtcagtatgtaggccacgttatgcgagatgcgggatgcatgagaagttagtttggaggtgtaaaggggtgcttatgtaatggagggtgggagaagtgggagaacacatgtatatgtggatgcacaagtacttgtacgagtgcgtggatggaaagcgtacgagtaccgacaagatggttcatgatatgtgacgtaggatattgatgagttatgggcatgccgttttggttctttcatacagcccatgccaacaaaagtctcaagtggacgctaaaatatatatcacaattacttgagcttatctcccccttctgctcacaagtacttgcacttttacaagcagtcttcagctctgctcagcagcatgtctatacaattgaatgagctcggccatgcggaaatcaatggccgtcaacttatcgagatagcccgtctgaagcaccaccttggtggtggtgtaatggttctcaaaccacacatggtgtcgcagaggttgagagatggccatcacatcggtgatgaactgcgtcgtttgcttgtagtttttgaacttgacatccatgctcaattttgtggcgctttcgggatcgcaggcggacccgtcggtctttgtggccttccagctcgtcaaataggccaggtaggcagcctgatccggaggactgagcggcttgaagatctcggctttgtcatcggttaattgcacgagtttgagagcagccgagcgggtgatgaacgacacggggtttgtaggaagatgagaggcagtaagtttgagggggagcatgttgtaaggcgagtattggtggtggtgggaagagtgggtgatgaatagtgcccaattatctcatgcagttgttaacgctaatcgggcagtaaattagtgatgatgaccttctatgatggatatgcagacgattattaatccaatgggatggtttgattttcaaaaggtcatgttgtcacatctccatcgatgcaattatttttttgatcctagggaaattcatttctcctgcttagggtctcccctacaacccaactactagaagtagtacagtacataccgtacatgtacatccgtttgagcacgagtatacgagagtaaagtaatacagtagctcgtggttcgattcccagaataaacggaacatttcctgtgaagaaaacacaagtacaactatggatcatcgtggaagaagcaacttgacgacagaagcattctgtataatgaacacctgcagcccatctcactttgttgattaagttcaggtctcttacacttgctcttctggccactctcggagcggaagagacgttgagattccaaccgccggaaccacgcgaaaccttgcgacgcgtgagtttcatctccaaactgctgttgcagtaagttttgacttctccctcagttgccactgtggaaccctattgttgcggaagacgaacgtttgcagttagattggacgagagttgggggaagtccagcgggcagtgagacctctcttcggggcttctatgggtgatattggggttccttggctggtgaccgggtgtcgataaactacgataaagcatgtacagccgaagtacaagtactcgttctcctacgagtatgagtagctgacactaccgattctaactgcaggttcaatcagaccagggcagcagtgatggcggtagagtgtgtttcaagagatgcttgggcctgtctacgtaaccggagagaccagtaagtagtactcgtacatactgtacatactgatctctagtctatttgtaagatgatcgagtcatgcccgtcatgccctccatcgtcatcggacacttgtataggatttagtctgcttccaagtcccctactgcaattaaacgcagggacataattatttcaggtcttgccctgagttgtaggagggacctgaatcagatgtcaacaaccaccttgagatattatcgacttgaaacaggagagtgtacgggtgcaattagtacataccgtacaagtagaaagaaaagagcactgccggcttagttatggtaacacaaagggtcacctacaagtggacacttgggatgtcctcggtctactacaagtactggcacaactttcggattcgaaacttcaactctagccggcatctgaagtcaatgtatttatggataggaaggcggggattgagcaactccgatatataatggttttaattgtgatttagagggcagggactgactcaacaatagagattacagtagagcaattgagcgcaatcaagtggatggttggtttcttttgctccggtttcaacaagtagtgtcgatatatttgaactcctacaatagtgcatctacggctctgcaaactcatggcaacatactttgtattgttactcgcaccggtacaagtacgtagctccaagctctgcttttttcttttcgacatcaatgtcgatgctttccgtcctgtttcagctgcagtgcaacatgtggtttcgtaattcaaagcaaggagtggccaggtatgcaaagataggggtgcgtaggcggaataatgaagagaggaagtcaggagacggtcagggatcggacgatttcagccaaggaaatcctttctggtattaccagcttcggtctcattcgtacgtcctgttcctaatgccagcgggttgcaacgttggactctaatattacagtatatgctttgggtttcacaaaattgtcaaccgcctggttgggtgacgtcatgcctcgcatttaaacggctctagccaagtaataatgttaatagcgttggagccgtaaacaacgctgagcgggttatataggagaacaagtcaatgacccgggtgtggctattctgacctgtaatcgggcgtcgtatcaggtgagctgatgttgatagaaaaaaaaaagagaaaaaagaaaaaaaaagacgtcattatcgtcttttggggtccgaattacagttgttggcggctgcttcaaacgcatgagtaagcactgcaatatgttgttagggtaacaaaaaacctacggataccgtaggtaggcagagcaaacacttcagatagatgtacgagtagatacaagcacactacaggagcaaatttgtgcaactccacaagtgcaatacccattcagtcattggtagacccggtttcattggtacgacttgtactcgtacttcactcgcgtttcaccggataaagccaagaatgagaaggacgaacaacggcctgcaacaagggacaagtgaaacaataaatctgacatgaagcaaagacagtcttgtgcatcaccttagcgaagcgtaagtagagtgggtcgtttagggcttatactgtaggatactctcagcattgttatccacacctacaatacgcccgatacccacctcaacgatcgcttgctaccagactctacagccgcacttgctcgtagcttggtctctctccgagtgcaaattttgggttgtcaaaagggaaaaaaagtactaagtaatgctggacagagtttgagattgcatcaacgcgtagcaatagagggagctggggagaagcaaggggactgaaaattgaaatggagaataatacaagtctctgccacacctggtatcactttgagcacattacgggaacagcagggtattgaaactggcttctcaaaagccaaggtttcacaatattttaggggctaagcttgtcgctaattttagacgacgatcagatcggagctaacgcgtgtgagatgcgagttgaggtgcactggtggaggaataaagagggcctgtaaagagaggtcgagagggggtagaggtcatggtgaagaaaaaacatattactcaagcagtgtaataccccagaacaccccagaatacttcacaacatccgtattcgaggcactaaattctcaaaccactagtgaagccttaataactcgtctattatacacataagccgagatacaccccgcgcttgttctgtactctaaattcaaaaggctaaagaagcagaggcacaagcagactgattttcgaagaagcggaaccaccacagctatcaaatagtatcgtttggcctggaaaatggtgagggaatttcatggaacaaagttcggagtcaagcaacggaagctgggaggtaacgagatgtaaaccgctgtgctacatgtgccacatgctcaatggctgccggagtttcgggattagcccctgagagatggatatttagtgacaagagggaatccctctgtttggctgccaggtagcaccactttaggcggtggcatgaggttgttatagggccacgtaaacgctcggctaaaccggagctttttcatgtaccttgggttgggacagtagggagaaagtcaattgaatgtcaaaaagtctaaccttaaagttaagaattttcgaagaagcggaaccaccacacaacacataaatatatttcttcccgctacacaccaacacacacacgacacttacaacatcatggacgatctggaaaagggtcctattgacgaccggcatccggcacccgtccccgaagacgaattcaacgactcgtcgtccacacatacaaacccgccccagccaccacccgcggttgctatgccacatgtctctcgtcagacccagaacccctaccagcacatgggccacgataacctccacgagtctgtgcaacaggccggcacccacgccatccacggctacccgcctgctcaccagatctatcaacagcccacttctcccgcatctattcaacccgaggatggcttccatgtgcatccactagctcattcgtatccactcgacaacgtggagagctcaaacacatacgctacggctgcccaggtgccccgaccaccgcccatcgacacctcgatcgccaacgaaaaggctggtttgctgcaggcatcaaacaacagccaccattcgacatcttccgacgatgagcccgaagagaacctgcagcaacgaatcgaacgtatggccaacggcaccgtccccggaggatcaaagatgcgacggtcggcctccaagaactcgaagcgtcgaggtagcaactccagtagcgccactggcctctacaggtcgaagacctctgcctctggtcgaagttacaagagtcatgctggagaggagcatcgagctaccggacgacgacgctcaaactccacatctcagcagcccggcagtgccatgccgccccagagcgctgtgacaaacaataataactccatggacgagtttcctcttggtcttggtatcacccgccaccagaccaacgccaccacacatactaccggagaccgaaccactaacgagaaggaagaagaggatgagaaacacccaaaggtgtcgcatgtgctggaaacggtgttcgaggactcggatgccgactccacggacctccccgaaatcaaggacgtcatgggcgacattcgagaagagcacggagtagaatctaccgaccactctctacgacctccggagaacgaggacaagattgccaccggtgtgcgacggggctaccacgcactccagcgatccactggtacccagcgacctaccgagttcaagatcatcgtcaagactcgagcgtacattcgatacctcatgcaactgtcgattctcactcgatgctttgttttctggttgcctcttgctgtcgtgttctttattccccttgctattggtgcttggggtcagcctgatgctgaactcggtaatgtccgtctctcgtggattttcatctgggtcgaagtcatgtggagctccctctgggtgtctcgcctggttgctcatgtgattcccaacttatttcgtgttattgcgggcattatttccccaactattaagcgatttaccactattgtctgtgccgtggaacatgctattacgctcgtcttgtgggcattttgctcttggatcaccttcatgcccgtcaccagcatgaacaagttggccaagcccaatgacgctaaagaggtatggcagaagaacttttccaaggtgcttgtgtcctgtcttatcacagccattgtctacctatgtgagcgaattttcatccacttcatctccgtgtccttccacaagacacagtttgcaaaccgaatcagagacaaccgtcttgccatctctgttttggtcaagatgttggacgccgcttacatggtattccctcagttttgtcccgagttcgaggatgaggatgtgacacttgctggtggccttctttttgcaactactcgaaagatggatgatagacttaaccgacgtattcagcaggctgttcagaacgagggtacccggcggttctttggaggactcaaaaaggcgtctaaatccttgggtgaagctgccagagatgtcattggtcgaactgcaggcactgcagcatctaccgagtccattgtcatggaagccatgaagtcgcgatccacagcacgaattctcggtaaacgaatctggatgtctcttgttctagagggacaagactctttgactgtccaggatatcatcgatgtggttggagaacactctcgagacgagtgtgaggctgtgtttgccgttctcgatcaggacggcaatggagacttgactctcgacgagatgtctgctgctgtgacccagatctgtcacgagcgaaagtcgatctacaagtctctcaaggatgtcgattgtgccgtcaagaaactgcatcacattcttgtgtttgtggttctgctgatttgtatcatcatttttgtcggaatgttgtctccttctgtcggagccgttttagccacccttggtaccaccctgcttgccttctcattcgtcttctctaccacctgtcaggagattctgtcttcttgtgtcttcctgtttgtgaagcatccaattgatgtcggagatcgagtcgatattgcggatgtcgcctacaacgttacatccttgtctcttctgtactccaccttcacccgaacagataatggtaagttgtgccaagctcctaactcgctgctcaacactctgtggatcggtaacgtctctagatcgggtctccagtctgatccccagacccttattttaggccttcccgagacttccactgaagacattgatgagctgcaccgacgagttgatcagtttgctctggacaaccccaaggactacaagcctaagccctggttccaggtttccggtttcaccgatctcgaccgaatctccatcaccatcaacatcacccatcggtccaactttgccgacattcctctttggggttaccgacgaaccaagttcctcaagtttgttgcgcagtgtgtccaggagattcctctgtacgtcccccgtcgagaggacaactactcggatccggccaactcgatgtacctcagctctctgcctcctggtatccccggtctattgcagagccgaaacgaccagaacaagtctcccagtggcgatactttcaccgagctctcctccgatggacggaaagaccgatccctgtccaagaactccacccgatctactcgatctactcgatccgctagagaccgtcagattcacggcgtcgctcctacctggagaacccgaattcgacctggtctccgtgtcatcgacgagtctgaggatgacgacgattatgctgtggaaagtgattcttcggaggatcacgagcatactcttgaggagaaaaataacactcatgccaccggcggagttcaggctcagactgaggttcagaacagattcaaaaactagctagcgtgacctagcacatgattcatctagtttggggtatcagttgtatcccagctagcttatatatattagcattacatcatttagaatatgacttgattgtgtattgtagctacttgtagagatggcatgtttgtcgatgatatggctcccacctttgttctggtgtgcaataatcaatactggcggagtgtgcatgacacaagtgtatatggtggaagtgatgtataaccaccatgtaattaaacgactaaaagagctggagagatactggaaacaacaaaaaaaaaaaaacgtctgtctttcctctatgactcagcatggttattccagcaccgaaacactgtatcctgctgttctgtgtatctgtttcctcacatagccaccctaacccaacacccaactctatcacacgaaactcatttacgcgtctctgaaataaaaaaaaaaaacacgtacccgacttacgcacttagacatacatctactacagtactacacaacacacatttcggcatgggtattaaaggattgaacaaattactgatggaacactgtcccgcggctctgcggtcgtcggagatcaagaactttggaggtcgaaaagtcgccatcgatgcctccatgtctctctatcagtttgtgattgcagtacgacaggctgatggccaacaattgaccaacgagaatggagagaccacgtcgcatctcatgggcatgttttatcgaaccctgagaatggtcgataacggtatcaaacccgtatacgtgtttgacggcaagccccccgtcctcaagagtggagagctggccaagcgaaaggagcgacgagaggaggctctgaagaagattgaggagctcaaacagcaagtggaggatggtgaagagggtgaggaaacaaaggaggctcaggaggatgttactcgattcgaaaagcgaacagttcgtgtgacacccgaacagaatgacgaggccaagaaactgctcacactcatgggtattcccattgtggaggctccatgtgaagctgaggctcaatgcgccaagctagccgaggccggaaaggtgtatgctgctgcctccgaagatatggatactctgtgtttcggttctcctgttctgttgcgacatttgaccttttccgaggccaagaagatgcctatttccgaaatcaactttgccaagattctggagggtctggaaatgacccatgctcagttcattgatctgtgtattcttctgggatgtgattacgcagacaccatcaggggagttggacctcagaccgctctcaagctcatgaaggaacatggaagtctggagaagattgtagagcatatcgagaagaatccctctggaaaactcaaggtgcccgagaactggccgtaccaggaggttcgtgctctcctgcaagcgcctgatgtactcgattccagcagctgtgatatcaagtggaacaatcccgatgtcgagggactggtggacttcctggtgagagataagggattctccgaagatcgagttcgagcaggagctgcgagactcatgaagcaggtcaaggtgaagccgcaggcgcgacttgatggctttttcaaggttatgcccaaggagggaggagagaagcgaaaggcggacgacaagaagactaagggtaagaagcccgccactaagaaggcaaagaagtgattggttaactattggtaaaagtaaaagaaaattaatgcattgaaacacatcactatgagcaccgtgcatggccgaaggcaagtacacatactacaatgcatctgtgtaagcaccttcttgccatatatgaaaaaaaaataaaaaaattgaaggtgtgggtactacacataaatctcatttactcgcaggtcgcaagaatcactctctattgcagttttaaacttatttattaagatcatggcagccgaggcagatatacttcggccctgcgtcaaaatttcaagcttaatgtaaatcgggaaaaacggagtgcaaaaaaaaaagtacttgtatttgtataaagggatgggaaaaggaacgtattcaaaaagaacaaaaatggacgacaccggaatcgaaccggggacctcgcgcatgctaagcgcatgtgataaccaactacaccagacgccctgaaattacagggggtttaagagggtcgtgccaagtttttgtaaaatcagtgaaatttttttttaatgaatcattagaataaaaaaaaaaaaaacaaccggaaaaaaaaaccaaagagataagaaaaagatggagcgacaacgatactggcagtatcggactcattgacacacgcaccgaaacgcgcatcgcatggattatcatggctattatttattgaacgccaataacccggcttactaggtatatagatgtaatgaatcattagaattaaaaaaaccaaaaaagaacaacctccacgaacatctttttgtcaactgtccagcgtccaagggcatctgccagaagatggttgtccctcttccatccaaaatggcgggcatggatcttactggaggtcaaggacagtccgttgaactacatttgagagctcgcccatgccttgtggcatttgagcgagccatgcaacaaactggcctagtgggtacggaccccgtaatcctgcgatatttcgctcacttcgtgtaaataaaccgtttccgagatttcgaataagctgtttatcaagactagaagtcgctctgctgtcgtcttataatgccgttgcgtcaagatcttgttctgacgatgtttcaaccggtttatctagctactgtatttgtagattatagcccgatgtatctatagtatgtactgtacttgtagctacagtacttaccccaaggtacagtgcaataagtaagacaccatttaataatacagttactctgcgctcactacaccggatctctgcactatcttcactgatactctagattaatgtattactgagctataaaagcaatgcaaataaatatatgcgtggcggttacttgccaacattctgcttacaagatgcaaaactctgaagagccttgaggaagactccgtaggtaacggcgtcgttatcaggctggtggtagatttctgtgagacgaatctgccagggagggaagccctgcaggtcaagctggggaccaaagacaatgagcaattctggttcagttacaacgagcatgttcatttgctcatcgatgacgtccacagtgatatcacgtggcttgagttttttagcaatggccagctccgacagggtcttggtgagatcgaccagacattctcgaccatcctcctcggacagcaggtggatggtgagatcattcttattgtcggtctttctgttgaccaccttgccgttggattctcctgttgggtgagctgctccagagtggggtacgtcgatcttgatggagggcatctccgagccgtagtatgatctcattccctcttccaccagtttgtacacgtctttgatgttgtaagatttgaggcatccggttcgttcgtatactgacagctgcttgatttcgccggttccgcaacaccaggctgcaatctccgagatctgggcaaccaaaccttccactcctccgccctcttcagagccatcctgcaggtcgacaatgacggccaggtggttgggcagcttggtgaggtcggcgacgtcatgagaaatgagctggggggttcggttgtgatggtaggagatggcgaggcctcggatcttgattctatgggccacatattgcacaaagtggaccagggagtaggcgaggtggaagaccagcagcacagtgtggagcacgtggaagcagatgaaggaccatggatcgctcggcatgaacttggggttggccgacgaggggtacagcatctggttaagacgggtaaacatagcggtggttgcgtttgtacgagtcgtgacactcgctgtgtgtggtggaggtgtaagtgtacaaacaaggttgatcagaaatccatcaaccgaaaaggtttatttatgggagtcccaaccagagagagagctgtagcatactgagtgggcaggcgagacaggcaaagctggtatccacggcaatatatatagaggaggacgcgctgttcaacccactacaacagctggttaattttaggatatatatggcgaaaagtctttcctgagccacccgtttctcactatctactgaccccctgtctcgctaatgcgcgttccaaccgattacgtgaacagtagtgacaggacagaaggaaaatactgtatgatgtgaaagtgaccctgtcagagttactgcaaaaatgccgactgtaactgtggggtgtgcagtcaacacgtccttggtcactgttgagtgatcacatatagtcgttggttgattgtaccacttggtgcatacgataatttgcctgtacctagctaccgtacaattgccggtgcaatattgattgtactgcgattgttgtgttggatgtagaccacacgtgtgtacaatagtccactacaagtacagtatgtatgtactgtactgtactaagtagataggaacatgtacagttaagtgaaacaaagagcgttgattgtatgatcacaagtaccgtgtgtacttgtaagcaacttgttactacaagtaatattaaaagaccaattatattaaaagaccaatacaaagaagtattatactgaacttgtactcctataattttgtacttgtacgatcaaacacagtagaagaagactgcagggtgcattcgcttatgttgcaggataatgtagtgctgatgtggactgtacaggtcgagagaagatgacaagaatatgagcgagagttttctgccgtgtcatctatcccaaagactgtacaaagagtcagacttgtgagtgcccattcttaccatataggcacttgtcgaatctctgttccaccgaggggaatcttgaggctgatacaccttctcccaagacaacatcgtgaagtcatacgaacaatctaagattgatgttgtgttgaggctgaaacgaagcatatggcaaatcgaagattcgatgaagatataaagggtcccccttctatcggatgacgaccatccctgaactatcagtctacaccatgcaacaaagatatctacaaccctatgacgacgacactctggtcgaagagattccacctacaaatgccgaggtgggaattgtgccatttgatgatctggaactggtggccgaaagtcagcctccttgcgatacctggaagaactgcgtcttatcatataagatgatagtccagggctatgacaatgaaatcctgacccatgaaggacagttgcaaacgaatttcgtaccgggcatgtctaccgccatttgcatgacttcaaatctgaattttgaaccccacatgactcccgaagacgtgcaacgggtcactttggctgctttggttcgtgaccgtcctcctcctgaggtggacgaggagtctgacaatgagctatgtgcacgtcagagtatggccatctacgaaagatacaagggccgaatgagcgaattgtggcgcgacatgcctgaattgccattatttgaagatggagacagcaagactactcctaaggcttcttctgaagatgatccctcaacttatgccgatgggtaccagaacgaggcaggcgctactgcgaacgattcccaaaacgagaacgatggtataggatatcagggtgtcgataattctcttcttccaggatgtgacccaagctcagactcgcattattcagattcagacagaccatgtacatcgcattcaatatctggtggagaagctgtaaagagaacccagatgctcaaagacagacgactctggaaacgagccaacgaaccccagttcatcacttgcacttcttgtccccgaaagagcttcaaaagtctcgccaaatacgcgaaacatcttgacacccaccatagtggactctccaacgaacacttgtgtccttctaagacctgcccaagatcgattgttggcttcagtactgctgttggatgttctcaacatttcaacatctgtcacagaaaccatgacaggatattcgaactcaagtgcagaaagtggtatctgaagagatggcggctaaaacccgagataccctgtctgtcaatgtatgtgttcatggtagacatttagaacggggtcattagctaacctcttttctgtcacatgcgctatttgtattgattgaagaggacgctgttagctatctgatacacttgatctctacagagaggaagagaaatatgtcacccgttgtgtaccacccgtacctgcattacaacttctacattttatatatatgtgcatactattgcgagtaggagaataaataccacgtactggacttttcaatggaaccgcgaagacattactacagctccatatcttttcatgatctcagcaactacagtttctgtcgactacatagctcaatccaagttcagtatgcataccaaccaaacttgcctaaggaaggaggtgtagacaattaggaaagagatagtggtcatctgagttgtattgaaaggagttttgtggttactgtagttacttccttgtttcaatcgctttagaactgcataatcgcccatccaacttcttgcaactctcacgcgaatatcacaagatgcacttttttcctgattcttaacattttcttaccacacaccacttcactatcacagcccaactcatctggtgaaagactgttcacatgacagctcaaaacacctaccgaatcggatcagtcgcagccggacgtttttcgaactccaacttctcacttgacatgaattggtatagaaagggagatgatcacagagaacaacacaacaatgtgagccatgtctagacaatatcgctcgttttacagtattaaacactcaaaatgaagaccatgaacacaaaacatctctaatgataccattttctggcatattcgccacatacctgaaactgacagacgacgatcactccaatcaagtcagaccgaataggaagtaggaagccttcctcggcgccttttcacaatatataaactgggttatgggctcttcattatctctacccttgatcaatcaacttccccaacatctctttcaccaacatcctcctttcagttttaccaacttcagattttcagcttccatcatgaaattctccactaccaccgttattgtcgctgctactcttggcctggctgctcctgctttccagcaggatgcttccaacagcgactttatctaccagctccaggtttctgacaagaacaaccagttcaaccagcagctgttcaccgatggaaccaacatctactatggtccccggaaccagaacactgctcctcagggccagaatcttgtgacaatcaccgtcttcatggacagcaacggaaacctgcagtccatcgacaaccagaaccgatacgtctctgttggcagcaatggccgaatgcagatgtccaaccaacatcgaggtcgatggaatgttcagaccaaccgaaacaacaacaatgatgtttctctgcggttcgacaacaaccccaaattcctggcttgccctgtccagaactacaacagcggttctcgatccagaggcaagcgagaagagtccgagtctgctgccgcccggaaggaccaccagaacaactggaacaataaccagaactggaacaaccagaacggccagaaggacaaccaggtttaccaggtttacgtcaacaacgctccctgtgccaaccccgttgagctgtccctgaacggccagaagcggggtcgacgaaaccagtggaacaaccgaaacaaccgaaacgttgcccgagatgtgtctactgagactcccgaggcaaccattgttcttcgagtcaacggagtcacccgacagaacgctatgtattctcctgtcttcaaccaggatggccgaatgtacacccagatgcagcgagacaaccaccacttctccgacgaccagcacggcaacaacatgttccgactgtcgcaggatggccagatcatcgacacccgatcccagcagtacgctcggcttggccagaaccagcagttgtccatgaccaacaaccagaatcagggactgctgttcactgttgacatcaatggaaacctgcagtacaacggtaaccagttcctagcttgtgatacaggaaacaacggtctgtacgaggttcgacctgccggagccgagggagctgcagcttcttgtgctaacgcccaggcaattaccatccagattgaccagcagtaaacgggcctaccaagcgtttgacaatgtcatctgacctgtgacaatagtggttttcaatacaagtttccagtattatacactatattgtggatctgcgtagattgtatctgtttcttgtcccctttgagtatcaattagttaccttgacgatatgcgactgtttcgtctttaggtcatgagagctgcccaacacggcactggatagatcggacttataggcccaatgctacaactcggattataaggcaccatttttgtttagttcattttacgatgcaattgtgggcaataaggtgacatgggttaaaggggttgctggaattactgtagggactcgcctcagtttttttgctgtaagcaacggatgttgagataagttccgacttcatacattcgtttctgagactcggagtgtctctggtcaattaattgaatcgcttttatgctacatccggcttgtttcagaccgttccgacatcaccaacagaaagaagacaatattacgactttttgggggggaattcatggctttcatattactgtgtcccgctacttgtagctaccttagagtagatgaaacactcccggggagcaacgtccttctttttttttgttctttggactgaacggtgtctgtttatctacctcgacgcacccaatattcgttgcatgttgacaagcaactttctttcattccgtgagctaccttgtacatatccgacccacaaggtccagacaagccaagtcggtgtctttagcctccttcttcatcccagtggggaaacggtaatagaacaagtggttgtcgaaaggagttggtgggggcagtgacaggaagatcacgccgtcttattgcacgaatttggaagctgtcaagctcgtgtcagagtgtgcaagaaccgacttaggatgtacaagagctgggttcgtgttctctcatcgtactacaatgtgatccgtgaaagactctactcaagagcacttctacttaggtgtctgcgtcaacttcgcgtgaaacatgatttctcgacacacgcaggccgagattaggtgtcagacatggagtggattgcgtgtgagcacattgtactcgtacttgtagcttgcatgctactgggttcctacaaacaggacatctgttcagtcattgcggctacctatggtacagtagctggcgggagaatttcgttttcacgtgtcaaaagacgccaatgaaagtcagcagtcttaacgccacaatagacccaagtgtccttggggggtgctgtagacctaccgcacacaagtacctatatgtgtgctcgaacttgtgctggtgaaaatatgctgccggatacattccacaatggcatggaggaaaaaaagaatggtagtttcgtatttacggacccacccagcttaaagtgggtctccccagcgtgtaagttcgaggactgggggggtcttgcagccatctacgataccgggtgttcggtgtccgaaccgaagccatgttccgcgatagacaatcggacttttaccagtttctgccccaacccttagctgccccactgtagcccaacaagtacttcttgttgtctacccacggggttagcttgtgttagtttagttttggtaccagggtgggcttgagggcaagccaagcccaggacactggaatgaggtcgaggtcgtcgtcataatatccgttcttgtccccgttttccgccctcaaatctgtgaatcacctgtcttactttggtgcccgtgtgttcgttgcacggctatcattggttctcgtaactttgaactctgagcagcaaggtttccatcggtggtggtgggttgggtgttaacgtaaattaatcacaacaaaaaaactaatggcaaaagggggcgtaaatagacgccgtctttggtcgtgtgaggttgggtttctaaggaattaacagaaacactttcatggaaggcggaaatggtgaaggactcggccagactgctgcctgaacctcacacatgtcgtatttgttgtgcttggcatgttcggacattttccatgtccgcttctacaccttgtctgcagttgacattgattgtctcagatctgcatcgctcaagcaataccgtgcaggtctcgcatgactataactgtatccggaacgggtggaaactcgactatgtgaagaactaaggccaccccgtacctccaacagcagcccctgcttcgttgagatgtatgtttttgtctcccaaacgtcactcgagagtagcgccgtttgagccctcgaataaggcactatttaggaccagaccacaccccgcggatgtcaagccgaaccttgttgcataaagataatactagtcaagtggggtgtcgacccgatgagagaataaaccgattgcaacggtttttatttcattcgcttcttccagcagacactcttggttttcttcctcacagctttccgccattatcagctgcgtgtatcgtgagtatattgggagtgagagatgccctcacgataagacaacagctatagtacaaatgttaacacagatgtcagatcaagcgccgccaaactcgcccggaacacgggtaccaggggagatcggtccccaacaatcttcccagcaagttcccatggcttataccatcccaggaacaacaagtacagctctagatgaggagatctcggagtaccgtgacaccaaccgaacgaccaagacccctgggatagacgagctgacacccacagcgttttatgacaatcgtggtgttaggcatgagcataggggaatatctgaagagatgaagaaggagctcaagagacaggagagacgccagcacgagatgttgcaacagaagcagcttgagctgagacaacaggaagccctacaccaacaccaaatgcttatcattgagcagcagaagcaagatcagattattcaacagcagaaacagctgcaacaactgcagcggcagcaacaggaagaggtggtcagacaacagcagctgcagcaacagcagcaactgtaccagtactatcagcaacagcaacagcagcaacagcagtatgccgcacacatgttacaattcgagcaacaaaggcgggagcagatgcgacaacttcagttggcccagtaccaggcatctcaggctgttcagacacatcatcaagatgtttctcatctaaccccgtctgttcccgtacctgcagccgtaacacagcctcctgcctccgtagcacgtacggcatcagtctcagacatgttggtacctcctatgacatggtcaagagaggagcctgcccatactccacaacctactcaatcgcgccgatacacacccacttacggtcctgcaaaagatgactatcgaggtgatagcggaggcaacagacacagtggtcatggtggaaacaggaggattgagatacccatcacaacaattattcaacgcccttttgagcactaccgttcccacaataagtctcctatagagttttccaccagtccttctgggccgtcagacagcgatgaggatttcggagacttgactgaggcagagattgaagttctacgacgtcaaatctcgacggataaagtcaaggtaaactttcttacactgttcaggtacgctaccaaacttgatatcttcattctgttcattggaatggtcacagctgccgcagctggtgtttgcatgcctctcttcactgtcattttcggtcagatgaccaatgagttcttagctttcattgtgcttggttcatcagctgaccgtttccagcatcagattaaccattatgctctgtattttgtctacattgctgtggctacgttttgcttaacgtcaatcaagacatacattactgtcgaaagaggagaacggttgagtgctcgaatccgagagaattatttgaaggctatcatgagacagaacattggctacttcgacaaactgggagctggagaggtgaccaacagaatcaccactgatacaaatctgattcaggaaggcatttccgagaaattgggacttattgtgtcggctgtttcctcgttcattacctcactggtgataggattcatcaaatcggctcgactcactggaattatgatctccactgttgtcgctcttgtcctggccatgggaatctgctccactttccttgttagatacgttagatgggcaattgaagacgacagcgagtgttcgtctattgcggaggagtgttttgcatcaattaccaacattgtggcatttggaatgcaggtgaagatggacaagcggtacgagaagcctctcaactcgagtctgaagaattacctgcttaaggcacgagttcttggagccatggtaggcatcctttggtgcatcacttattgcatgtatgcccttgcactctgggagggttctcggcttgtcaacaagggtgagaccagcatcggtcatgtcatcactgttcttatggctctcatgattggtgcttttcagttaggaggagtcgctcccaatatggaatctcttggatctgcagtcggggcgggtaagaagatctttgagaccattgatcgagttccagatatcgattctctcagtggaggagaaactctctcaaatcttcgaggcgctatctcgtttaagaatgtccatttccggtacccttctcgccctacggttcctattttgcgagagttcaacctcgatattccctccggagctaccgttgcattggttggagcttctggatcaggtaagtcaaccatcgttgcattattggagcgcttctaccagcctctaggaggctccatcacagttgatggtgtgagcattctgtctcttgatgtaaagtggcttcgtcaacaaatgagtcttgtttctcaggagccgactctgttcaattgcactatctttgaaaacatttctcacggtttgattggaaccgagtatgagaatgcagagagatctgttaagatgaaacttgttgaagacgcatgtgagcaggccaactgttcagagttcatcaaaactcttactgacggtcttgacacacaggttggtgagaaggggtatctcttatcgggtggacaaaaacagcgagtagctattgcccgagccatcatttctaaccctcctattctactgcttgatgaagctacgtcagctctagatactcgcagtgagaagctggttcagcaggctctggacaaagctgccaaaaaccgaaccactattgtcattgcacaccgtctgagtacaatcaagaatgccgacaagattgtggtcatgtccaagggtgagattcttgaacagggctctcatgacgagttgattgctgcaagaggaacttactatggattggttggagctcagagaatcgaagacggaggtccagaaaccgcatcgaccacagaaaagggctactactgggaaagcggttctggatccgattttgacgttggtagtaatgtgtctgtcgaaaagacgactcctctcaacacctggggaatgatcaagcttctagctcgtttcaaccgaaatgagcgacttcctcttttgcttggatcgggattcgcagtcatctgtggagccggatacccttctcttgctcttctctatggatctgtgatgcaagcatttatggtcgaccctttggcttacaaacatatgctccacgagattgacaagttctctggtttcttcttcatggtgggaatggtccagctgggatcctacttcatgcaggtttactatctgggtgtggcctcagagactctagtgaggaacctcaagcgaaccatcttctcacatcttcttaaccaggacctgcgcttctttgacaccaccaccaccggcaagttgacttcttccctgtctaaagatacacaaaatgttcagggactaggaggagctacctttggacagattctgtcgtctattgtcactgttataatctcagtgattctctcctgttgctacacctggaagcttggacttgtctgttccgcctgtattcctctcattctatcctctggcttcttccggttctacattctgacccagctcaaccagcgaggacgaaaggtgtacgaatcttcggcgggatacgcctgtgaagcaacaaacaatatccagacggtgatggcgttgactcgagaagacgatgttctcaatttttactcttccaaggtcaacaatgtggtgtatcactctgccaagagtaacgccatcagtagcatgttgtttggtgcttcgcagactctcatcattcttatcaatgcccttggattctggtatggctcaacattgattcgaaaacgggaaattgacatcaaccagttctttgttgcctttgtcactgttgtctttggtgtccaatcagctggatccatcttctccttcactcctgatatgggtaaggccaaggtagctactcaaagcattcatgaaattctcaaggtgaaacctgagattgggggagacaaggagtcaggtctttctcttgatcctgaaaaggttgtgggcaatatttcattcgacaatgtgagattcagataccctgaacgacctaaaattcctgttcttcagggtctgagcctgtccatccctgctggctcatatgtcgctcttgttggctcttctggctgtggcaagtcaactactatttcgctgattgaacggttttacgatgtgcttcaaggaagtatcactatcgatggcattgatattcgagatctcaatcttggatcgtatcggtctctcatctctctggtgcagcaggagcctattctgttcagtggaactatccgagagaacatcttgctgggtgctgaaggagatgtcgacgatgctaccttgcattctgcagctatccaggccaacatccacaactttgtcatgtccttgcccgatggatacgataccttctgcggaaacaagggcacgttgctttcgggaggacagaagcagcgagtggccattgcacgggctctgatacgagaccccaagattctgttactggatgaagccacttctgccctggactctgaatctgaaaaggttgttcaacaggctttggacactgcagctcaaggaagaaccaccatcgcggtggctcacagactatccacaattcaaaatgctgattctatttatgtccttgaagatggaaaagtcttggagcaaggtactcattctcacttgatggcgaagaagggacgatactacgagctggtcaagttgcaagctttggagggctgacgtggatgaacgattacataaaacactaatggacatcatacaatgaatacagtacagttattattatgtattaaatctgaattaccccttagtctcattggtctcctcaatctttgtaccgttgatctcaccattggtctcaccgttagtcacgccacaattggtcttactgttaacctcgccgtttatctcccttttagttctctctccgttgtagctgagcacggcaacaccctcaacatgcttggtctgagggaagaagtcgaagcctcgaatggactcaaccttgtattcaggacactgtttcagaaggtaagccacgtctcgagcctgagtatgcacgttacaagagacgtagaccagtctctggggttggaaagtaaccagctggttgatgaaggcctcgtcagtaccctttcgaggaggatcgataatcatgcaagtctgggcagggtcacagtcgagatccttaaaaatattctcggcctttccggtcaggaaaacggcgttgttgattttgttgagctcggcattctttcgagcaaacttgacactctcgtcggagatctccactccgtacaccttctcaacagcctgagaacaggtgatagagaacagtccagatccacagtaagcgtcaaccaagaatcggggaggcttgccgccgtcgaggagaatgttttctcggacgtatgcagtgacagcaggcagaatggagttgttgttctggaagaactcgccagcagtaaaatcgaaccggtagttgtcaatgtattccgacacaatggctttgttgtcagtgacgcacctcttatcgaaagtcccttcctccttcttgatggtgttctctcgcaggaggtatgtctttcctcgttttgcggtcttgtagtgaagtttgacatcttctcgggactccttgagaccctcgcggacaacaggagttccaataggacagtcttcaatgtccaaaactcgattgacagtcttcatgttgaaaccgtagggtggtggagatgcaagccattcgggcgatttggtcttgggcacgtcgtaatgaggggttagtttggttcggtagcccatagtctcaggagaagggaaagtgggacccacttcaggcagaacagcgtcttcagtatggcagtagtatctgaaggcgttgacgaccacattccgcttctggttcaattgtttctcgtagtccatgaactggtactggcagccagagcactctccgaagtatttgcagctagtgagagcgtcgtctctgagatctcccttgctgataacttcgacaatctcgctctggaaaaagtacaggtttttcttgtagactcggaccttgaccttgtcaccgggcagagcgaaaggcaccaccagaactcgcttctctccatcttctcgctcctcaatagcaattccatctccatcagcacccagaccagaaatggacacctcgacctcgtatttctggtgaatcagctccttctcgggtctttctgttgctccttcgtcgctccgctcctctcgtcggattttcttcatcatggcaggactgatgagtttgttctggacctgatccagggtggttggagggttggctgcacccagaactcgcttgatgtcgttcaaaagcaccgaatccgaggccatgggatcccgcagtgtgtcaacaatgtccagcactgcattctttcgtgctcgcttcaacgatttgtgactttgtgtgaccatcgttcgtactaaccgtagcatatactggccaactgatttttttcccatccaaaaaaatccaaatgttcaaccttaattttttcgtactgtgcgccaactctatcgtattacatgaaagcattattgacagtgtattgattggtgggcgacgaacatgatggagaaccaatcaactagagtcgtaaaattgtgggagatagtaaaatgtggtttgtgcatgttcgtagatgttgcaaaaacagtcatgagtcctccttctgctacgagtagttcatatataaagcggcttattactgtagtttgggatgctcaagaagtctcagattgtccggtagctgtacaaggtcaggaagcgatagtgttaatattccatcctccaaaagccattgagtcggtcttatggagatttctttctctgtcatacactgtatgtgtctttctaaacgaacttgatgttctctacgcttgataatctcgtaacttctaacaatatgtacatactgtacttgtagttcagtggtgatattaatgaagtatcacgcagtacagtggttaaagtacttccagtaagggaatcaaagaaagagtaaaaacatgtacgtacaagtggactcaatacgggtatcgagatactgagaaagtgctttgagacaccagcgtagagtcatttggtggcttgctagggtgactaattacctacgaactgtcccctcttagttatagggtcatgaaaaagtcacttggatcgaaggtctaactagatgagtcactcataaagtcataagataagcacacgatacttgtaagctactcgcgcgtactggtgttgatgtcttatcatggtaacgatttgactcaatgattcacaccaccatgtcaacattgtcgcgtgagttcaaactcttccacttttgcagccatgcgaatacagttgtccaactcaaataaatcacggcacccaaaatatttacagtatttctgtagtgtgttcgtcacatcccatcacagtcgtcacatcattgtgaggaagatgtgagcacgctcgtagtgcccaagaagcgaaatgttacaggggcagaattaaatcgtgctacattattcttccaggtttagagaggcggacgtccgtagaaagctagacgccagtcaacaagcctggttgttacttgaagaagaaaacgttttagcaagagatgcagcttttatagtgcatgtccaactcccaacccaaacccaaactcaaaataagcccgacaggtaacgtttttttcagagtcataatttcacagatcacccgtgagttggttagtacaccattttccgaacatcacttaaaagattggcatttcccaggcaaggaattgcacacccccgatttttgcgatacatgagtgaatccgcacagccccccgctgccgctcctgctgcaggagaggccaagcccaagacccccaagcagctggaaaacgagagaaagaaggccgagaagctggccaagttcaacgccaaacaggctgctaagaaggacgctcccaagaaggaggctgcccctaagaaggcaaagaaggaggttgagcctgttcccgagtttgtcgacaagactgtcaagggcgagaagaagattcttgtgtctctggatgatcctgctctcaagtcttacaaccctgccacaatcgaatcttcgtggtacgagtggtgggagaagcagggatactttgagcctgagctcaaggccgacggatctcccaaggacaagggtctctacgtcatccccattcctcctcctaacgtcactggagctctccatattggacatggtctcaccgttgcccttcaggatggtctgattcgattccaccgaatgaagggaaagactgttctttacgtccccggtttcgaccacgccggtatctcgactcagtctgttgttgagaagatgctgtgggccaaggaaaagaagacgcgacacgatctgggccgagaaaagttcaccgatctggtctgggagtggaaggaggactaccacgttcgaattaagaaccagttgaagaagctcggtgcttcgtacgactggtctcgagaagccttcactctggaccagccccgaaccaaggctgtcaacgaggccttctgccgactgcacgaagagggcgtcatctaccgagcctcccgtctcgtcaactggtgtgttgcccttaacactaccctgtctaacctagaggttgagaacaaggagattgatggcttcactaagatgaacgttcccggctacgacgagcccgttgagtttggtgtcctcacccacttctcctacaaggtcactggctccgacgagaaattgaccgttgccaccactcgagtcgagaccatgtttggagacactggtattgctgttcaccccgacgataagcgatacgctcatctccacggcaagactgttgaccaccccttcctggaccgaaccattcccattgtcactgatgccgaggctgtcgacatggagtttggaaccggagccgtcaagatcactcctgcccatgaccccaacgattacctgaccggtaagcgacagaacctcgagtttgtcaacatccttaatgacaacggtactctcaatgaggcctgtggcgattttgccggtctcaagcgattcgatgcccgaaagaaggtcattgagaagctcaaggaggttggtctgtttgagaaccagaccgccaaccccatgtcggttcccacctgtgccaaatctggagacgtcattgagcctctcctcaagccccagtggtgggtccgaaacaaggagcaggctgatgttgccatggaggctgttcgagatggccgaatcaccatcacccctaagacctccgagtccgagtacttccagtggctcggcaacatccaggactggtgtatctctcgacagctgtggtggggtcaccgagctcccgtctactttgtcaacctcgagtctgaggccgatcaggacaaggaggacggcaagtggtggattgctggccgaaccgaggacgaggcccgagaaaaggccgctgccaagttcggaactgacaagtttaccctcgagcaggacgaggatgttctcgatacgtggttctcctccggtctgtggcccttctctctgctcggatggcccgacaagaccaaggacatggagacgttctaccccatgaccatgctggagactggctgggatattctcttcttctgggtcgcccgaatgatcatgctgggtatcaagctcactggcgacatccccttccgagaggtgttcacccactctctggttcgagacgcccagggccgaaagatgtccaagtctctcggtaacgtcattgaccctctggacgtcatttcaggtatccctctcaaggacctgcatgccaagctgcaccagggtaacctggacccccgagaggtcaagaaggccgaggacggacagaccatgtctttccccaacggtatccctgaatgcggtaccgacgccatgcgattcgccctttgtgcctacaccaccggaggtcgagacatcaaccttgatattaaccgagtcgagggctaccgaaaattctgcaacaagatgtacaacgccaccaagtttgctctcatgcgtcttggcgacgactacgtccctcctgctagcgacgctcccggcaaggacctctctctcgtcgagaagtggattctgcacaagtacacccatgctgccaagactgctgatgaggctctgcagcacaacaacttcatggactccaccaccgccgtctacaacttctggctctacgaactgtgtgacgtttacattgagaactccaagttcttgattctcagcggtacacccgaacagcaaaagtccgctcgagacactctctacacttgtctggagggtgccatcaagatgatgcatcccttcatgccctacctcaccgaggagttgtggcagcgactcccccgacgagtcggcgacaagactgagaccatcatgcgagcctcctaccccgagttcaaccctgcctttgataacgccgaggccgagaagggctacgatctggttctggatattgtcaaggccgctcgatctctgctggcccagtacggcattctcaaggactcccagatcattgtccagggctccgacgccgtgtccaagaccgttggtgagcagaccgagtcgattctgtcgctggtcaaggccgccaacaaggtgcagtccatttcttcttccgactctgcacctgacggatgtgttgtttctgtcgtcagccctgagtgctctgtctacatccttgtcaagggtctcgttgacctcgacgccgagatcaagaaggcccacaccaagatcgagaagtgcgagaagtccaaggcttcgctcgagaagcagatggccgttaaggactacgagaccaaggtgcgagccgacgtccaggagtctaacaccaagcgatttgaggctctgaccgccgagatcgagggtctcaactccatggttgaggacttcaagaagctttctgcttaggtggatcttgtaaatctctactgaatgaataatgtgtattgtattgtatgagagtgtaaaggtagtgtgagtaaatatacgtgtgtgcattaatatgaacttgtagaagtaactaagagacagctgttgtatttgtatgattgataccaaaaaagtacagtacatccatacttgtacttgtacgttggattcgttatacgtgtctttgatcctacttcaacatgtcgatccttctatagaaatcctacaggctcctgccctactatgtatcattcaagtgtgtcataaactacagtacatcctgtcatccgcccattattacgtgtcttttcatgtctatccattaataggtataaattaccgatgcattactcctgcccagcatcaattcgaaggccctccttaacacccttctcaatccgctctctcatatccagagccacgtcttcacatgcacgtgcggcctgctcaagcacctcaaacagttggttctcggtgaactcaccttcactctcacacatcaacagacccgtggccttgttgttctccacgaaatacgaaacagcatgtgtagacgtcgactgagacacctgttttcgagtgggatgcaaaatgagcttatcgtcgacaatggcaatggcgactgctgtaaaaagaccagtcatgggcgttctgctgtcaatcaatgccagacacacggcgttcagacatgccgctagcttgagcacgttgtatccggttccttcaccctgttcaagaatctgaatcacaatctgaagcaacatgcgagggtacaagtttcgcaccactgtggcggccaaaacactgtagattcgatccttaatcagtgtctcccgggttgtggcctgtccaatagcaggacgaatcaccagctccacctgagctagtgtaggttcatctgtccgtcgccgagtttctatgggacccgtgaccgagcaaatcacacttgttccttgctcccatttggcagatccatccacattgttcaaaatgttcattttgtgtgtgtttttgtatgctggtgatggttaatggcaatatggcatcctcgaaatatttcttgcatatgaactttatcagagaggtgatgatgactaagtggtgcctgaaaattgaatcggggcaaacctctattattcacgtgagttgtattatttgttgtctcatgtgggttcttatgggccctggaatcttttaatccggtccttatgtctgtaaggtgtatactgatagctctgagagagaacggtagcgatgacaagtacaaaccagtacatacagctgcaagaaccgtggtagtagcaacctactacaattagtagctacaattgtagtccaagtaatagttacaatattaaccattttatagcactaaatgatagtgactccaaaacaaaagacaagggctcctgagtaagtggctcgatagtgttattatgtaactactgtattgtacaatatcgttctcactgtagcaatgttccacccacgctccccactatacaaccaccgccaaaccctgactaacgatgccgcacgattggagcaagggctggttgatttctaactggaataggctcgtatttttcaatagagggatgatgcaaggatgcggttgtgatgttagctcaaagtgcttgtaactgaatatgcttttgtataaaggagaaaaattgtttgtaattgtgaagagactggtttggtaaccaaaatcaccttttcagattattttttcatctacgtaaaccaacaatacaagagtccacacctatcttcaatagccgactctttctgagtggaatttttccggtcgtaaactctaattttagcttggtgcacgggactggaaacgagagccaactgaaatcatttaaacaataacaagagaaggaagacaccaacctactgctcaccacccatgtccaaccacctttccagcgactcggatatctcgtcaacggagtccatgctctgtggcggcattgccggcatggtgtcgcgtttttgcatagctcctctggacgtggtcaagatcagactacaactgcaaaaagatggaagtcgctattatcggggcatttttcagacgatgcaacagattgttcgtgacgagggtgtcacggcgctgtggaagggaaatattcccgcagaactgctgtatgtcttctatggagctacccagtttgtgacataccaccatgtcaaccaggtgatcaatgcctacaacgaaacggcagagaaatggaagatttcgtccggtgctcagtcttttatcgccggagcaacggcaggagcaggagctactatcgccacgtatccttttgatctgttcagaacactgtttgcagctcagggagccaagaactgcaacgtgaaaaactacacgtccctgtttcagaccttcaaactcatctacaagacggaagggcccctgggattcttcagaggcgtatccagcagcatcatctcaatcgcaccctacatgggtctgttttttgcatcatatggacgtgtcaaggattcattggatgccttttcaaacaaacatcacgaccttctcgtgtcctacaacctgcctaccaagggttggcaggaggcaactgccgggttgtgtgcgggcacagcttcaaaggctctagtcttccccctggacacaatcagaaaacgtctgcagacacaaggaagaatggatgtgtcttacaaggagctgtctggcaagcctggagtgcagcgactgcttgactcatacaacccatttgtcatggcgcgtcggatcatcgtcgccgagggatgcaggggtctctacaaaggctttctggtttcactcatcaaaagtgcccccactagcgctatcaccatgtacacttttgaaaagtccctcagcattctgcgatggtggaaggcacaaggaaagtcgctcgaggcttgattgcattatttattagcatatacagtaatactgtacactgacgatacacgtcatcgaaaaaacctggcactgaatgaagacataaactcagatgactcaaataaccatgctgatcaaaaagtaaacatgagtcattttacgtcgtacaagagacacgggaaagagacactgagtcattttctgcattgagattaaaacataagacattcagaacgtgtatgagacgtgactacaagtaagtatcgagttatcagtggttagcttcgaagctcaaccatacatttcttactcttaacttgaactgagtaaaaaatacgatgtcaatggtgtgattatacggtatgagtaccataggtgttgcagcgactggcttttctttttcttctcgttcaactcaagataacaaatcactccttgggggtattcgtccacatgtagttaggaatgctctcggtgtttaatatttgtgtctgtctcttcaaatataggtcctattgtacatacagcacttgttgataactgtgtatacagttagctgcaggttactacagtatgttctacttcatttggtggaacatcagtatacagaagcacacatgtcacttgataatgagtctaatcgtttgagcgtcttttttctgttccctaagttatctacatgcttgatcacttcctcgagctttgctctcagagcctcttatgcttgcattaaaaagaccatccctccatgtactgtccatctccaaagaccttgaatttgtcgaattccacagcagggacgtttcggatgttcttgcccatctcctggtcaattagcgactcgtaggagtggtccaggaagtcctccatgttgtactggggctttcggaaaggctcggagatgatcttggccagcttggagatattggggtggtaatgagactggacagtctccagctcccacaaagacgactccaacgcgttggtcttgagaggatcggtctcttcgggatcaaatgggtcctcgtactctccttcaacgtgtctctggagcagagtcatgcatgcagggtgtcgcttgagctggttgtagacaaaagggtagagagtcactacggcagcaggaggagctgtgagggcaagtcgagagcatctcttgataaaagaggcgacaatggcactggccaaatgcgaggaactcaggaaaatgtcgagcagtcggaagaaccgcgatcggtaagatgcatagagaacctgctcgtccagcagagcgtacaacttggagtagaagtcggggtattccaggttctgcttctgcatgagcgagaaaagaccgttaagagccagcagagcaactccacctcccatgttgtacgattgggtaagaaaatccatggtggtgtgaggttggttcaggaaggggattatcttttgatgcatgactgtcaggacagtcttgtattgatcgttggtctgggggagacccaggattcgaagccatccggtctggaaggccagagtctgtgtgtcatgatgcaaaatggcgtccttcttggaagtgggcttcttggtccagaatgaggtgatctctgcattggatttggggaaggcagcagcatcggcgtgcagaaagagttcctggattcgaatcgacagcttcttctggtccacggaatcgggaatgttggtctgtctgaacagcttaccagactcgttgtagacatgaaatcgaatatcgtcgtacttgtccaggtactcagatacaaagtgggacagtgtactgagattcacgtcgacagaacatgtggcaatggcccacacaatctctccaagcagtctagtggggaaccaagacactccatcggcactccagcacttgttctctatcttgattagtcgcattagaatctcaagagccatcagacggctgttggcggacttggaggtgttaagcatcttcagaacgtgcttcttgtaagtctcgtacttaggagagatccactcggccacggtcttcttgttcagatcaggaaccttggtcttctggtccttcgtcttgggttccagtacgtgatccgggttcaacagcaaatcctccttggccatgtgtcggaaaacattgtatagactgttgagagcagctgtgtggacgtcttcgtcggtagacttcaacagagacatgagctctgacaacttgttgtaattggtggtggacgttgtgatttcggtcccgagactggaaatttcctcgggagacatatgcacggccgacttggccttcttgaccttctttgtcacttcggcagctcctcgtttggacattttgatgttgtgttaggtggtttgtcccacaaatttcactatgcacatttttttgaccacccggcatggttcatgcatgtcgtcacaagtggatgccctaaccttgattagtaagtggttagagggtaggaagagcaatacagagaatgaggtataaactacttgaaaatagttgggtgaaacactagataccactgtatatttgatgtatcccgcttgctatatattttaggagcccattgtatcaagttatagcttaacgtctctccatatgaatgtgcggagagtatggagtatgtagggtatatgaagcgtgatcggacccaaaatttcttctacacaagtagcccatcaatgggtttactacacgcacttttttatactgttggtgtttgtagctagctgtatccgcaaacacgtatctttcatccgccataaccgtgcttgtgtagagtaatgattgtacgagtatgtacttgtacatacaatacagtagtgagcaaattgcggcatgtgtattagtctgtacaagtagtaagagtcggagtcgtctcagcaacatatcattaggcaagtcttacactacagtgagacatctggtacttgtacaagtacttgtagtcatctccaaaacacccccacccctcgcttactacacatgcttcaatccagcatctgtacagcaaggagcatcgatttccacaattttttttcactattttcagccaattttaattcaccataatatctcttaaatgcactcactcttcacgtacagtagacacctaaataagcttttagacccgaataagtaccgggttacggtcccaacctcttaaccctagccctggagcccaatcctcgggccggccgggtaacacgtacttcgctcccattggcccaatctctcaaaatttgggtgtcaaaacctgccagcataggattgcacaacaccacatcacggttctacttttttgtgtacccatacagcactaaacatgagtctcagaattgctgctcgactgggtgagtatcgactgcgaatggcgagaaggacgcctgacgactgaatttgcaaattgattgcgtttcgaccggtttttgaacaccctttgactaactctttagctgctcgacccgctgccatgccctttgcccgggttggtgctctgtctgcgtgagtattggagggaggaattgcctgctgtggagaggcggaaaatggactacgtggcatgttcaattgaggctgtggagcggagaattggatgtctcttgagagactgaaatttgacattagagtgtgacatgacaggacgcggtaattaccacagacgttgttgtgacgaggtgacaggatggggaatgagatcgacgacaatgcgactgcatgggattatgacgacgaacgacaatcgtcgcgtagtgattcaatggcgtcaacgactcgatgcatctttttccgtcccccaattgcgacatcatccatatcagccaccacatcaacactgtcttcttcaatatggacaccatacgaacacatttccaaacccgttcaaccgagacatactaacccagccgacattactccaaccaggttgaccccaaggtcaaggccacctccatcctggactccatccctggtaacaacgtgctctccaagactggtgtgctcgctaccggtgtgctcggatccatctatgccatctccaacgagctgtacattgtgaacgatgagtccattgttctcggtgtcttcgctgccttcgttgttgttgttgccaagctcggtggccccggttacacctcttgggccgacggttacattgagaacatgcgaaacattctcaacaccacccgagacaagcacaccgacgccgtcaaggagcgaattggtgacgtttccaagctcaaggatgttgtcaagaccacccaggatcttttcgctgtctccaaggacaccgtcaagctcgaggctgaggtcttcgagaccaagcagcaggttgttcttgccgccgaggccaagtctgttcttgactcttgggtccgatacgagaactctgtccgacagcgagagcagaagctcctgaccgagaccgtcatctccaagatcgagaaggacctcaaggaccccaagttccagcagaagattctccagcagtctgttgaggacattgagaagctttttgctaaggcttaatttatagcatagaatgactatacgatgaatgaaaggtgcgtttcgcacatgatattacgccagaggtatatgagaatttgcaattgtagaggcaatgggtgcaatgaaatgaacgacgtgggtattattgagaagacatctccttttgtatgcttgtttacataacttgttcagtttgtacagtagtagtcatctggtcactataagtaccattcaagtattgttgattttggtcacatgagagtagaaattggtgcttgtaattgagaactgatttcccacacgaccatttaccgtgacacttgcaactattcgtttcttctttctgaacaggttttagacactacacacgagttggagtacgagtacgtacgctagctagctacaagtagtacgcacacttcataggaatgggtatggagattttgtatacaggtttttgcggtatcaacatgtcaagatgtcgattcaattccatttggcacattgaatcaagacctggcctcgccgaagctcagaataatctatgtgagccccttatctgatccggtcaatcccatttccctctcacactcacacacgaaaccctagacagggtaactagcatcaaaagtttgcaactctaatttttcggtatatattgcagctggcacccacttctcggactttaatgaccttccacgttttaaacgtttatgatgaaaattatgcgtgctagctgatttgccccctcctcggaggtagtccttgaccggacggcggcatcttatgttgatagcgtttggcgcacttaccttgtttaaacaaacgcggtagtactttctgatccttatcatgtggcaatggttgtgaatcgtgtagatagttgactatagttgtaccttccttgtacactcgaggactttgttcaggttgcaaaggtgtacaattaagttcttaggtgcgacagcgtttttgtacatgcctctgttcttactatatttttcatgttactactgtaccatagaaaacaaactcttggcccccacttggaattggcattgatgtacacgatgacagaacaatatacttgtaaaagtacttgtattagtgcaatggcgtgaagtatcgtacttgtacatatcggtaatgcatcgtacttgtacttgtacgatccaatggtgtgtggtcatccacttctgtgtttcctacttgtaatgtatccctgggtcatcccatgtcaaactgactacatacgattatccaagacatgtagatgttacgagcaatagactagctactatgctgtagagtatatgctgtaatgtaaatactgaacgagatcaacagcttgaactggaactggatcatcccatgacttgttctgtcgatctgctggtctgaagccctgcagtttacgcgcttacaagacattgattcctattcgtatcatagaatattccgtttcctatattaaagcgcacgattgttgtcttttgatgttgcttcatgagattcaattgtactggtttcgattcaatctatatattcctacacttcagtgatagcacatgattcccatcactccagaccttttacagtccacgccattttttgtgagaacacaatgtctgtatgtagtatgtagctgtctaattacttgagcttggcgttcttctcctcgacgtctcgctcggccagagatacggcggcctggtacatctggatcacgttgatgacctgcttgagggcgcaccagggggcggtgacggctcccatgaagacgacccaggtaacggggtggccgttgacagtaaaccaggggttctcgtaggcaaagtcgaaggaccacaggtacagagccacgaaaaagagctcgttggcggcgcaaatgccaaacagcaccgtggtgttggtgtagtagagtttgagcagctgcgacttctcgccgaccttcttgtgactagacgatccgctggtcagagtggcgtacatgtgcatgtagtgggaggcgagatcgagcgacacgagcagctggaatgccacggcatagttggggtacgccacgcacaggtagcagatgagcgatgaggtggtgcatcggtcggtgaccatgtccagaatggctccaaacgaggaggtctggttgtattttcgggccgtgtagccgtccagagcgtccagaatgcacgacagacagtatagaatggtgcagtacttggggtggaatcgcatgatcagtagagatgcgagagccagtaccacccgggtgtatccaatgaggttggggatgaacaggaagatgtccaatgtcgtgagttttcgtacggcaggcattgtgagggctggtgttcgtctactgggtctgtttctcacttgtgtcttgttgattcggagttattcggaaataaaacgtgtcgaatggaatgatgagtgtgtcggatgaaaagtcgaacgtgtcggagtcgtagagtcgtgcaatcttctcaaacaagccaaatcgagctgtgtcctcgctaagatatgtcgtcagaataaaaaaaccagtggtccaccgctcagaaaaacgtgtatcagggtgttcttcaccgcaagttgcttgagggaaaaaagcttagtgtgctgctgtgcgctgtgcacccacccacaaagtcgaaccgtatgcagaccagtacacggtgcagcgtctaagcttagtcatgtgtaacgtgggggggatatgtgaagtgaagccccgaagtgcaataaatgtgtgtcagcggaggtgatccacggacctgtgtcaatttccctccactccccttgccaacttgtagtcttcagagccactctcaagcttctgttttgttttttgttttttcatatcgcggtacctttttttttttattggaaccggaatggccgtgtctttttccagcctcgttttttgctgctggctgccaatccagtgccttacgctaagctaagtcaacagggatgcggagttagttgcagactcacaagagagtcatgtgaaataggtgatgtacagtagaggtggcaaaccaatcgctcaccgcctgtgatatctaccgttagggagccattacaatatatacagtacactgctactccatctacaaattagacctcgactaattccactaactatacactgtacagtatataccgctccttactctgctgcaacattgagactggacctctttcaacgagatgaagaaggaggcaattggcgtgaaaatacgtcggacatataaccatgtcagaagaaacaaattcaggtttcagatttcaatgcctatttgatatttttatattccccctattggacacaccctcttctatataaacattaaagtgcgcttactgtagtaacctctgactaaaccagaactgcaactgagcagatccagtgtgcgaggaaaaccccaagttctggtacttgtgcttgtaattctacatttgtacaactcttgattagtcctacaaaagggtcagacacttcgttcaaactcttgaacagctgttgcacctctcaaagcacatggcacccctacaacggacaaacaggcccatagggcggtactcaatcctaaaaacactctcttgtcgttttcaacttctcaaattcacactcaaaacaattagcattcaagtacacccactgctcacctgtccacattcactcaaaatatctccgcggagttaatgtccccatttgagacgcagctagaaattcagaaaattagacttccgacatgcagtgcagaagaaaaatatattgtcaggccaaaagccaataccacgagtaaccagcagtaccaaaaatgactactctgaagaccattttgggcggccctctggctcccgaccatgtttctgacctctccaacaacctcgtggttgttcttcaccaaatttacaacgccaacgctctgactacagctgatgagaacaccctacacaagtttagggtgcgagtgtctgccttccttaagtccaacgactcccgacagcggtggtgtggtgccttcctggctctggctgccgtccagaactcctgggagtgtctcaaaaaccacggagccacctggttgggcatgttgattcacattcttgagctgcctgaggcccctgctacctgggagatggcgctccgagctagtgctgagatgcttgccctggtgtctcagaagaccgagctgacccgtgagattgctacttctcgaattgctcccctttccaaggctgctctggctattttggagtctcctgagaactgtagcccttctactgccgcagttttcgtctctgagctgcagcgagtcaacgtggcccaccccgtgggtttcagaccccattccaaacggttccagtctgctcttatcaggctcattgcaacctcccccgactctaaactcgtccagaaggcctgtgacgctctcaccgtggcccactactcggcctccaactttggagaagccgccgaatggagagaaggatgcctgtctaccatctctgacattcacatcgccgtcaatgctctcctggagggtcgaactgatgacgctcttgcttccgtggagcagacaaagtcgtggggattcgataccaagtccggttcctctcccgccgacatttatgccagtgctaaggcaattgaaaacctgtatactcttctgactgcatttttgagccagcccactgctgtgcccgtcaagattcctgttggtcgtatcattcctctattcaacagagtcacctctctggcccaggtccacttcaaggcccatgttcctctggttgagcagaacctggtgcgatccacattcgaacgaatcaacattgccgccatgcagtcgctttcggctctcattaacactgttggcgctaacatttctgcctacgtcgaggacctgcttgagactgtcgacatgatctctgctgacaactctgcggtgaccttggctgccctggatctgctcacaaccatcttcaataacgtcggatacatttctgctggctcttctgttcaagagtacgttgagaaggccgtttcccaggctctggttctcatcactcccggcaccaatgtgtctcaggccggccagactgagatccccgattacatctccaagtctcatctgtttgagtctcccatctcccatatcacccaacagactgtctacacatttcttgaggccaccatgctggtatgtgacctatctggacgatgtcgaggactcattgaccgaactctcctgctttcgaagcatgctgctcgacggtctgctgccgtcacttcagcgctcaatccctctatggcttccaagcacagtattctagccatggttcagcagcagtacccccgagatacttccatttcccgatttgtgcatcctagacttcctcctctgactaccgaacgacgatacttgcctgtttcctcgtctcttggagaggaagaggagcttgacgaagaaatggagattgaggaagaggaggaaaccagcggaattgagcctgtttctgcgtcttctgcgccagtcactaccaacacatttgcttctactgctttcagagaacctgagaaccctgtagttgtggatgctccatttgagcccctgcctgagacgatggcagaacctgttcaggctattgagagaccctctaatatcgaacccaccaccgaatttgaggaaattgaagaggaggaagttgctgagaaccaggtcgacgattctgacgaggagatgggctcggactttgagatgcccgctttggacgtcggagacagtgatgatgacgagtaggatttagacaggatgcatgcaataattagacgttaactatggtatggagacgtattacaggattagtatagtagctatcgtatccacagtacatgcgagtagatgggatgggcagatagatgtacatctgaaaactgttgtaggtgtacaacaatggccatttcaagcataaaaagaattgtgcagatacatcaatacggagtggattttatatttaactgatttggaatttccgtttatcaccttcccattcagcaatattcattttccattcctctgctccaacctgcatcacatgaccgagcttaaataattttatctgcatgcaggctgaaattatttctggccctcagttacgatacacatcgcacacaaaaaatgtcagacatctcggacgtggatgcttttgaccagcaacaggaaaagctccttttggagcagagtatgcgtggagacagacgtcgtcactatgaccacatggagatgagtgacgaggaggttatgggattcaagcccagcgactctgaggatgaggaagacgacgatgatgagattctcgaccgagaggaagaagacgacggagaggcccaggaggcctggggcaagggagagctttacggtgccgatgagatcgaggacgaggaggatcgaaagctggaagctgaggaggctctcaagcttcagaagaagcaggccaagcagatgaaggagagtgatttccttggagagtgggccgccgacgacagtgatgatgaggacgaggaggatgcagatcttgctacagccggcaagggtgttcgagagagcattcctgtcaagcctatcgagtccatgtcttctaaggagcagtatgatcagcttgttcgactcaaccccgagctggttctcatgaacgctgagcttgccaaagtgactgaggagatggctgcgctgaacaaggctgaggaggatgaggatgatgagcctgaaatcgtggagatcaaaaagacggctcttcgaacttacattggagtgctgaacgcctactttgcgctgttcatggactccgtcaagaacggaaaagccaatatgaaagatcacatcatcatggaagccattctaaaagcccgggaaatgtggcgaatggcccaggagattggtctgcccgaggaggaggttgatgagatggcttctgatgaggagatggtctctgagggtgctgagctgatggatgcttctgccgccgagagtgacgtctctgacgatctcgatctgtctcgattccgacgacgacctgaagacgatttcgaggatgtggaagaagtggaggaagaagttgactctgacgacgagcttgctctgcccacctctttcaaggccaagaagtccaagtccaagatctctgctgtgcccgactatggtgagcatgctattaatgacgttgatcaggctgacaaggaccgacgaaagcgagatctacggttctataccgccaagatcgacaagcaggctcgaggacgagaacaggaggagattgagggagacgctgacctaccgtaccaggaccgatggtacgagcgacagcagcagctcaaggaaaaacaggccgcccacatcaaggactcgggagagcatgatctctacgactctggagacgagggaggatctgctgatgactaccaggaaatgtcctccaagaagagcgctggtggagatgatgacgaagatgtggatgagtttgttgctgccctcaaggccaagaagcagcagcgaaaggcggagcgagaagccatgcatgaggtctacctcgacgccaagaagggcaagattgacgtggaaaagctggacgacaacggaaagcgagccatcaattaccagattctcaaaaacaagggtctcacgccacaccgaaagaaggagaatcgaaactcgcgagtcaagaagcgaatcaagtacgagaaggccaagaagaagcttgccagtacccgggccgtctacaagcagcctactggtgcctacgctggtgagaagaccggtatcaagaagaacctggctcgatctaccaagttccgggagtaatatagatgcatgttgtaatagaggttttggatttgaactgaggttgtaaaagttttggctggtcatggcgtatactaactgtaccggcgcttgtacaatagtctggtaattctgtctctgaccgtctgaaacagattagaaatcaaatgggcgtctcagtagttattctgatatatgctcatgatagttacgctagcgagactacaagtacgagtacttcccggtactgtacggtactgagcttcctgagagtaagataagtgtctatagttttttggagtagctgtatactgcaataaatgaacataaaggctcttgatacaatttggatctttcagcatgaggtgagcatggacagttggttcctaccagccctctctcaaacggccaaacaccctttatttggaccgcatgaccgctaaagagacacactcgtatggtataggctgcctacacaaccgtgattcttcaaatgaacgcaaacgcatactttgtattggtacaaatgacagccctagactcgtatttgcatactccacatcgtgatatcagcaccccatgtctcacgtttatctgcggtggcttgggtgaatttcagacaatgctaaaaaaaaagaaagacaaaccgagagtcaaaatgcgcaggcagaaaaagtgtggaagagaaaagtaaaaagtaaaaagtgaaagtgaaaagtgaaaagtgaagtgaaataggggaacgatatactgggtgatattggggttaatctgagaaacttttttactgataatcatttgatatctctcgcatatcccttgggaccccttttatatctcatccctacactccccattatatccctcattgtttacaccccgtacatacgattatgcagcgcggcatctggagacgatagagttagtaaaggtatattttagtgcaaaaacataatagaccctattaaatcgtcgagtgtgaaagatagcgtcgcagttgttcttttcaccattacttgtttgcaatacttctactcatcgcttttccttcacacaaaacactacaacatggccaaagcacaagagaacaagctggaactggctggtatcctgctcttcttcattctgtctgctgctcttttcaccagagacattcggtctttccaacgagacattctgccgtcctacatggagacggatatggccaacatgctgggcatggacatttctgttttccttttcatcgagcgggccattctctttgttacacctcttatcattgccctgaggcgaaaggccgacgatgatcaacctcagcaggagtttgacgttcctgtcgagctgctcatgtaggcctcgacgacccatactaaccgcttgactgctttttctcgacagtcatccaaccacatagacaaagagattatgaacagagtaccagtatgtgtagggaaattgtagctgtcgtaatagaggcgcagtgtatgtatctacttgtggaatgacgttgtcagttgaaaaacattgtattccacacattgcatcaaacgtcacaccgacgtcaaacgatattagtgcgtttgtgcatctgattattaagtcacctgagtgtccacaactatccatggatcatcctcgagcagttctaactatttgcgctttcttcgtgtgattactgtatggtgtagatcattcaaggggttatgccatgccaagattgtgtacagcccacagcaagtgcaaggggtaagtactgtattgcactggtaacacactaaggtcaccaccacaatccacacgcgcccgcaagcccctattcagccgtacataccacagctttccgtcgcgtgcgatgtatacataaagcacagccgaagtaccacgcacagatctccgtgtttaacttactgtaggcccagtggatcgcgtggaatgtaccagggtgcagggatgggtgtatgaggacattaaactgatacagtatgcaaatcaaccgttattatttagtcacgtttcaaattgagatctccttccacagttttattctcataatcccatcgcacatctcacaactgtctatcacttgtccgtgggatgttcatgtctcagtttcgggcttcgcttagaaatattaactcaaaaaaaatcaaaaaaaatccatacttgtacgatacttgactgcacctcctgcaactgaatctcctcccactccagagtttgaactttgtatcgtggcggagtcgtgggagtggagctgtgaagacgtgaaagaggtgctggggagagctatttcaggcgcggagatgaggtagacgcatagaactaaatgcatttagtagatgtatacaagtaaaaataccggtacaagtagtacgagtagcagtttcttttatttctacagtatctacagcttggaggcactgtttcatagggtgtatgagttgtgcttgaacattagtgtgtcaggaagtacggtcgatacgagtaccggtagctacaagtagtacaccgtacattcaacaaccgtgtcaccgcaacccattgaacaacttatgtggcagatataaaactcagagttattgcgaacatagtttttatcatctcccctcatcgcgtactcgtcaatccccgtttttttttcactgtcttatgtcattctaactgtatactgtacaagtacaagtgcattaaaccattccacatctctaatgcacctctgcttaacccaatctggtgtctgttcatggttgtcatggttacggcctgagttgagaggtttgacgatcggacgtaagtaaacccgaattcaatgaggactggtacttatagacctcatcacatgcagaagcaataatgcgtcgatagttgaatatcaatgaaatctataaatatatgtacatacagtttggtccgcttagctgtcttgagacgtagtgtttgccgcggttgtctcgttagcaacactatccccagttgtgtcaccggtagcactggcctccccgccttggtcaccatccaaccgatccatctcccgctgctgacttcgcagcatttcaaccatggcctcggtgtccatgctggcgttgacaatgtccatcggcaccttgttctgcgaatgccgctgacaagcaaaagaagcgttacgaagttccttatcaatcaaaagcagatcgagatcgaaagaaggagaagtggcatccagattgaccaatgtcgaccattcaatcagagagtctgtggtgggataaaacacattgaagtccatcagccacaccttgtcgtaaggctcaggaatgtagacatcaaatacaaagctagagtcggggaaagtgtccttgatgtgttcgtagaaaaagagctcgatttcgcccagaaaccgctccttgagcttgatcaggaactcgtagtagttttggtctctctgagtcacagcgatgagttctctatccttgacgaagcaccggaattccaatgcagggttgatgttgatccactttctgagaaccagctcaaacgaaaagtccttaggaatgcctccaagtttgtccagcatggtcagatcgtgcgcaatgtagtcactgctcttgagaagcagatacacatcgttgactgtaacacatctggtcgagttagagggagagatccaaatcgcgtcttgaggactcgaccagttgagcttgggtgctacagctccaaactcatcaatcacagcttggaccttggggtggaaatcgtccagcttggaaacgtatgaatcaagctcgtcttcgtcgtcagaatactcctcgaaaacgccgctatccgatccgtagctggttttttcttcatcaggaagaataacaccgtcctcactcagataattgacgaaatcctcgggaagaggcttgatgatccgggtcttcggtgtgatggacttatatagcttgtaccaggccgagaactggcagttgagaagatgctcgcgtgtgagagtcagagtcgtggtatcgtcaaccttggtttcctggtcctttttatcgttgatgatcatgttgctgatgtatatcgtgtacactatctccacagatcgatatctcaaattatccttcatcatgcaggcagacctggcaaccatgcaaggctaaccacgtgagtcgccactacctacacgtcttgttccagaatgttccatgtgggattttgacatatattatgagtcttgcgatttcaaatcacccgtaataccagctatattatctctgttttccaatttgcccttctccgccgcccccagacacgcctcaactactgttaccctaccgatcaagaaaatcccattgccaaaagctaatcacccaaaaatcactactacacctgtatatccaacacaatgagcgttcctacaggcacaaagtccggatttaagaacaaggaaaagccccttgaggttcgaaagagcaacattcttgctgctcgaggtgagtatctttggattggatgattttggaggcggtttgaccgtgcaaacccgaatttttgtcgtcatactaacacatagccgtggctgatgctatcagaacttcccttggtcccaagggtatggataagatggtgagtacttggaggagtggagctattgaagttttggttcgattgtggcgattctgtgcgacctaagggtccgatatggcatgtggaatcaggtggaaggagtggctttatgcaggcatattatgatgataggggtttgtggggggggtcgttgattttggcgtccaatgatgacacgtttgtcgttgtcatacaattgttgaattgcccctgctacgtgtgtcttcacgcgttccaatatgtccgcctgagaccacgttccatggctaagtgaatgtctcgtacgcctcgatattgatacaatcgcaatagctaaaaagtgatgagaatatcgttcggatagcacacgacctattcagccgactaacacagatccaaactgcacgaggacaggtgatcatctccaacgatggtaacacaattctccagcacatggccgtcatgcatcccgcagccaagatgctggtcgatctctctgcctcccaggactctgtcgctggtgatggtaccacatcggttgttattctggccggatctcttctcggtgctgccgacaagctgctcaagaagggcatccatccctctatcatcgctgagaacttccagaaggcagcccagcgagctgccgaggtggtcatggacatgtccaagcccatcgatctgagtgaccgagagactctgattcgagccgcctccacctcgctcaactctaagattgtctctcagttttcgtccaccctggcccccatgctggtggacgctgctcttcaggctgctaagaagacccccgagggtggcctgactctggatctcaacgacattcgaatcatcaagtctctcggtggcaccattgaggacaccactctggccaacggcctggtgctcaacaactacgcagtcaagaacgctggaggcccctcgcgcatggagaaggccaagattggactcatccagtttcagctctcggcccccaagcccgacatggagaaccacattgtcgtcaacgactaccgacagatggacaagattctcaaagaggagcgacagtacattcttggcctggccaaggccatcaagaagtccaagtgcaacgtgctgctcattcagaagtctatccttcgagacgctgtttccgagcttgctctgcactttttggcaaagctcaacatcatggtgatcaaggacattgagcgagacgacattgagttcatctcccgatctactggtgccaaacccgtggccgacattgaggccttcactgaggacaagcttggctcttgtgatctggtcgaggaggttgagtcttccggctccaagaccgtccgattctcctctcgagagggatcgaacaccgtctccattctcgttcgaggagcaaatgacctggtcattgacgagactgagcgatctctgcacgatgctctgtgtgtccttagatcgctgttccgagtccctgcccttgttcctggtggaggagcctgtgaggtccaggttgcacaggttattggcaaggagtctcgagccatggacggtgcttctgccatttgctacgaagagttttctaacgccatgctggtgatccccaccaccctggccgagaatgccggtctcaacccggtcaacgttgtgaccgagctgcgagttcgacacgaaaagggcgaggtcaacgccggcatttcggtgagacgaggaacgtccattatggtggaggagcatgtcattcagcccgcattggttaccacctcggccatcactctggctgccgagtgtgccaagggtctgctcagaattgacgatatcgccttttccagataaatatagagggtatttagagtatggtatgattgttatgagagaggactacgaccggagaaattggttcgcgtaggtactactgtagttagctacgagcaacatgtccttgtagtccgtagagacaagtagtatcgtatttagtgtgtattggtacagccactaacggtgcaagtacagtttgtactgtagtggtgtgttcttattatataatgctattggatatatgctgtttattcctcctcctccagtgtctggccctccttttccagtctccagattggtagaccaactgtcttagggctcttgatgtaaatagttttggttgatcgagctcccccgtccacgaggttgtcgacgatgttgtttgccactcgatgcgagttctcctcgatctccttggcggtattgtctggcaggtatccgacgagggcagtcagattaacagcgccctgctcgcatgccattgatctggggagcgtcaccgacgtggatcgaagcaaacctcgcacctgtgccttgacgtagtccggatcggcaaacatgtttgcgtctcttgcatcgtcttcttttccaggttggatgaatctgatggggaacggcttagtcagatgtctcagagaaatcttcttggacagtctatcataacactccacgacctcctcgtggattcgggagtcggcgacaatcagatcgaagtcctttccgacagacaaggggtcctttcgcaatttaggtcgaaacttcttgaccgaaatgatatcagcaaatgtgtctttggtgctagcttcgtcagcctggaagatctctgcatatttggcggtagggtgtggcactatgagcagtattttcgcctgggatatcgacttgtggatcttgtggtgcagaggaatgacataggggactgaaatgttgttcatacctcgctgcccgggaactctgacattggttttggatgttgtggtgacggtgaggtggacgggaattcgctggttggggtcctcggttagctcctgtttggcggacttgaacagtgccttaatggctggcttttgcgtgagtttcatcttgtcgctggtggtctggatttttttgtcatctttcgaaaatattcgagacctgcatgtgagctgtatgggttagggattgctaggggtaaactagttgagctcctgtcaactaactttagttggcattacttgtgacaacatttgtatggtaggaaggttcggcatgttatgatggccaagttgaggtcatatagcagatgatggaggacacggcaatcgttgccacagacagaatgtttcatggaatcacggcctatccgagcaaatacgactacaactacgagtactcgcacacgcaccacacgaacaacgcgacacagcgagcactatacacaccaatcttcgccaccagtcatgagttccctcgtcctgacatcgaccgcctccaactttgtttgattgtggcgtacaacatatcacggtaaaatagagtatggaagcagccaagatgtagcaaacctgctgtccacgtgagccacgggagatataatggtagctggatagtgtctgacactctcatcttcctataccactgtctgcttttcaagcccaccgcacacagagatacagtacacgtaaagccatacaacatcgcgtataggcatagaccaacggaggttacacacaagagcacccccagacactcccaacaacaaggttttgaggggagttacccggaaaagttttcatctacaacactccttcccatctacccaaggtcgatattacccggactcgtttcgcgaaacgcggtttttggacagatacaggaaaacgcaaaacagtgtacgcgacgagcaccacgtgatacaacgccagacgccgccagaccacaacgtgacactcacatccacacagccacctacacacaagatgcccaaggagggtaagcccgcgcaggaaggcgcacaggcgctgctggatctccaagacgaaggcaaggatcctcgcaatgtcaaggatgacaaaaagacgagcgatggcaacaataccaaggacgacgtgggcgaggagaccgtcgagggcgctctgatgcatctggtgcgattcactcaggacgaggagaaacgcgaaaaggagaagcccggtgttggtgtcggtaacaacggaggagctcctgcaggccagcaacaacagcagcagcaacagcagcagcagcagtacgaagacattgctcattatggggaatttctcaacgacaattctgacacgccatggaaccagaacctgttttcggagcagtttgccgtcgcagctgccactgctgccggcgagggagacttccaggaaaaattcaacaaggaattcagcaaggagttcaacaaggagttcagcaaggacgagttcaacgagatggtggctgctgccgctgtcgagattggatctggaggcgctccccagcctggcgcaggtacagaatcagacgcacaggctcacggacggaaacgaaaacgtcaaaagacgtcgctcaaccccaaacaggacctgaacgtggatcctgtgctcgagggactcggagaggccgtcaagggaggagacaatctgctcctgatggacgatttccgacgaacagcaggagttccaggtcacccccacgaccaccctgtcacgtcacgtgactacatcatgcctcccgagtctatggtcgcgatgcgaaacaccagcaacgctcccaaggttgcagcctcgaaacgccctaattggacaggtgacggttcggagtctggaggagcatttactcccgaggagatcgagaagctcgaagagtatattgagggctactgccaatcccatgtgtgggatcgagaaatgctttgccagcgagtgtggtccaacgagcgcaaaaaggaccatttctgggactccatggccggtgtgttaccccatcgaacacgtgcttctgtatataaacacgttcgacgagcatatcacgtgtacgagacgcgggcaaaatggactcctgaccaggataagcggctgggagacctggtgggtgaaattggaccttgctggaaggacattggacaggttctcaaccgaatgcctgaggattgtcgagatcggtggcgaaactacgtcaaatgcggtaacaaccgagcctctcataaatggactgcctctgaggaaaacagactttacgagattgttcgtgatatgctgagtgcccagggagaagttggcggtaacatcaactggactgctgtttccgaacgcatgaacggaactcggtctcgaattcagtgtcgttacaaatggaagaagctgagcaaacggggtcccaaccatcatgctgctctgacaatgaccactaccgaccaccaggtgttcctcaagcatctggatgtcaatgattacgcctccgaggagcagattgactggcaaacgatcgctgccatggactctcgaaacctatgggctgccagtgatcttcaggaggctctggagcgactcaaaaaggatgtgcccgactgggactcgcgaagtttcagggaaaacatccagttgctggccaaacgggctgcggacggcgagaacttgggccaggcgcagctgccaggccaaccgcaacaactgccgggagcagcgatggccggggcttcgatgcagggacagcccctgcaaggtcagccaatggcaggccagccgttaccgggccaaccacctcatggtggacacggtcacgacgaagcgaccggtatcaaaaaagataatagcaaggagtacgagatgccgtcgttcaactggcaccaattggccgacgcgcagatcagttagggggatggagaagatggagattggctggcatgccgaatgtataatagattaggagacttcggtgtattattattattattattattattattattattattattattattattattattgatcaaacgggagccctataagtagagatgtacaaacacttagctggcgagagtgtagtgtggttgtgttgtgttgtagatgtttgagtgagaggtgcgtccatcgtggcagtctgacagcgtgtatcagatcgtggtgtaacttgttgctgaaatgaaacacagggtaaaaacagatacttgtacaactacagtatgtacacctgtactctttaatgtgtgtgtctttcgtttcgtagcagatcaaatatctatcgtaagcacaatatcgtttttgtatccgctcgcccgaaggacaaataccgaggtgatttcgaaagagcaaaactgtttgccataatcaaagccattggataatacatcagaagctggtctcagaatcagctgcttctcttggattggcacaactacgaatacagcacttggtattgtgtgttgctttccacaagcttgacatgtagtgattggatggcttttgagtcgcctcactcctactccacgacttttcgtgatacagaatgttctacacaagtacctacagcacctgtaagatcgatggtgggttctccgcaagcgatgtctcatattcagaatcaaggggaagtcttattgaagcttcgttacgtaggaggaggcagtggcaaatttaccatgacacgtgaagaccaaaagaatataaatcgagtcgtaatccacgcttatcaggacgggttttcttgtaccatatgcaccattcgcacgagagtacttgttcttatacccgtagcacctactcattcttgttaggcatcttagcctctcagccgtgtaaagagcgactcttcacagaacatgagtttatctctacagtactcatatggctacagtaactcattacaaatctcattaagcttgacgatttttaatacaatatcttactagattttttcaagtttagaacttggagaaggccttgttagccttaccggtggcaggcagaactcggagaacgttgaatcgaacggtcttggagagaggtcggcactgaccaacggtaaccatatcgccgttctcgactcggaaagcgggagagacgtgggcagcgaggttcttgtgtcgcttctcgtatcggttgtacttggggatgtagtggaggtactctcgtcggatgatgatggttctgtgcattttggtggagacaaccttaccagtcaggatcttgcctcggatagaaatgtcaccaacaaaggggcacttcttgtcaatgtagtcaccggtgatggcggcagagggggtcttgaatccgagaccgacctccttataccatcgcttggtctttcggttgaccttggacttggcgttctggaagatgtgaggttgctgagttagttgtgttcgagtgatgatagatagctgtacagcctgtcatgctactatgagtgcgtgctgtttgtcgcaaatggtcatatcctcccgtatctcggccctggatgtctgtcgcgtgatctcaaatcaataccaaatgaccacctgttgtgacttgtcgagtgcactcgttgctcagcaattaacagctcctcctgtcaacaattccctgactcaccttctggaaagctcgctcgttctggacgtgaagctcggacattttgctggtcgtacgttgttcgggagaggagaatgcaaacgatgattttcaaactagagtgtgcgagcctaaaattttgcgtcatcacgtgcagctgggactttgtgactgtcgattccaaattgggacacaaacggcatatgaagtttatttggtcggagtgtgtgacgacattaaggtttcggctagacgacttcgatgttaactaatgagatgtcgtagttgatatggttagttgggattatagttgggtatctggagtggagagatatcatccatatccacacccacacacgcaatctttgctacatcggcccacaatgagctatactaacgctacgccacttcaaccagcattctagacgatgcatgaagcgtgctatgtatcacgtgcacaatgatcgttatttccctgctgtcgataaagtgaacgtcagggtacgagctcatacaagtagctatcgtacgaaatacaccaattagctccagtagatcgatgtctaagagggttcacgtgatcatgtcatactatttcgaatcgccattatgaagtggcaataaactgtgacaacagtgtccttatgaaagcatgagtcatttcaagtgctcgtagtggctactcctacatcttcgaccatcaaatacaagaggtagatacgtcgaacctacttgcagatatcacgaaaaagtgcagatatgaagccacaattgataaatatctctaatcgaagtagagtacaagtacgtgaagtagatgtagagttgttacacaaccaacatgacttccagaacggcgatatcgacttccccggcatattcagcgggctcgttatcctctgatacagcaatatcactacaagtaccgccaacaccgccaacaccaccatcagactacattactcctgcaccaacatcaacacatacggcggccatattgatggcttcagtggcgtcggcaagagttggagtggccgaggtagagtcggactacacacttcctgctctttttatgtgtgtcagtctcccttttcttatctttggtttctggggtcttttaaagggggatccagcagttgatgagactgctgagtccagtgagcagatacgcttatccaatgcctccagtgggtccggtgggttcagtaggaagcccacagagaagcctgacgaaacttgaatatgttttgagcatcatacgcagctcttgtgtgatgccatagactacgaaggacatatttcactccatgaagatgctttctggacctgcttagttcatgtggtgcgagatgttggtcaggacatgaaagaagcagactatattaccagcacaatactcggtactgtacacatactgtacctttcctctaatcaaacgataataagtagttttttctttctcagtattatacacattcatctcagatagtcttcgatagagtccatcgttccagtccagtctgcgaaacatactgtcttgagaagtgtctgtgtgcattctaattaaattgcaagaattcatttgatcaataagctatatatcttctaggaatgtattgaggatttgtaaccaagccataatacgagtacaattgtactgcaatgaccgcacttgtgcgttttattcagttgaacatgcgccaggcacttacttcagatggtccagaaaagaacattaccagtataagtacaaaaacaaaatctcattgattagtatctcatataagtggagtgtactacagtacaagtacaagtccacttttttctctcaaaatgacctcaaacaagttttttacggactccgatcttctcaacatagattatttttcatgtcggttatagactctaaatgagagagtcatgttccaggtttgagggtatttgacatggatataatgaggttgtcgttttgaaaatcgctggtgatgacaaattgtgtgacagaatttgatttcggcttctgttctggcttctattgcaggattaaaactgatcatggacagccgagaaaactattcttgaaatcatattatggtatgtacatactcatactgtagtggtgtaatttacttgacaaagattcaccacgatcgatccaaagactggaatgatagccgcaacacaaccaaaaaatgacatccaagtaggtagccaataacccgcctcccatatctgcttcgtcttttccactgcttggaaacacagactctggactaatgcatgcgtagaccgtctattgtatcactcatcagtgtctcccgacactagtttttggcttactaactggagtctagaccgtccctcggcgcaagtatcagcttcggtgcgttatacaagcacatttgagggttgcagtgtggaagaatcgtcttcagagtgtatatattgatacaataccacaacagagagagcgagagagcaacaccagcacaacatcctacgctgaggtaacaccatatatatgcactaattgtagcccttcttgatgtctctcgctcttgtcttttccacgtggctgaagttgcccgcgtttgtagcacaacgttggacgcaaatagactctgccaatgagagatccggttatttttcttacgggcctagaatggataaagttgagagtttggcgcaccccacgaagttagaaaggagggtgagagaagtggagggcgatgtttgggggtgtctgtggggcgtttgagacgaaaccaagtcttgatacgcgatcaaagaccccgaaagacgcaattgaggccccaaaatagctcttttccgccgacaacagcccaaacacatcctctgcaaatcatgcttagctttgtcactgtaactttgggtggtgtgtttcttgagctgtggtagcacctgaggcgagacgggtcgtgcctgtaatggtccatgtagttaacatatcaggctcaaatttctcacatgacaaatacatacttctctcaggcagccagcgcagacaggaatacacttgcgcagtgcagctcttcacccactgctgcattgtcacggtcaggtcatatgctaaggatactatttgtagtagtgcgagtgcgagtctcgaaagacaaagtaagatactgactatagatgagatagcaataaaaagtgggtagtagcaatggcgtgtgtttgagctgagattaatgcctgaacactctcctgggaaatacacacacacctctacaagtaaggcactcaccactacaccccgctagacttgccatcatcctctgtcgcaacacaaagcaacccctcacctgcataatgtaagacgcctggcagaaacctaaccacccccactatatatataactagtggagggccgcaaagttgcctccttatacacaagacacactctcaagatgcgatctttccgagcagtccgaaacttctccaccaccgccaagcgcctcagccaggcccccaaggcctccactcctaacgcctcctctggaaacggctttgtgttggcctttgtggccgccgccgctggagccggtgcctactactactacgccaactcccctgccgccaaggtcgagaccttcaacgccaccaaggccgactaccagaaggtgtacgacgctattgccgacaagctgattgaggacgacgactatgatgatggatcttacggacccgtcctcctgcgactcgcctggcactcgtctggtacctacaacaagtctgataacaagtttggctcttccggaggtaccatgcgattcaagcccgaggcttctcatgctgccaacaatggcctggttaacgccagaaacttcctcaagcccatccacgagaagttcccttggatctccaccggtgatctgtacactcttggtggtgtcaccgccgtccaggagctcggtggccctatcatcccctggaagcgaggccgtgtcgacgagcccgagtctgcttctcctcccgatggatctcttcccgacgcctctcagggcgctactcatgtgcgaaacgttttcaacagacagggcttcaacgaccaggagatggttgctttgattggagctcacgctctcggccgatgccacaagcagaactctggcttcgagggcccctggactttctcccctaccatgttcaccaacgatttctacaagctcctgctcgacgataagtggcagtggaagaagtgggacggaaaccctcagtacgaggacgtcaagaccaagtctctgatgatgctgcccaccgacatggctcttgctaccgacaagaacttcaagaagtgggccactgcctacgctaaggaccaggatctcttcttcaaggacttttctgctgcattctccaagatgctcaacaacggtgttgacttcccccagggaactgagatctgggagttcaagcccaagaacgcctaattctggaattcggcgatttagaagagtgcaagcgctcgattaatgtattgtaagttatccatcatcattgacaattgtattgtagtgtagacttctggctcagggttcaagccaagccaagctttctgcagggagagatgtaatgaactgtatcgtgttcgagacttcgacgcattagctacagtatatcccgtactactactgtatccccgaacgaatacaccgaaagatgttgagatgtactggcttgtatttcatatgatccgtgtacttttaggggaggcaggtgtgctgagatctctatagatagataaatacatgcatgtcatagcttggcacctactgtacgtgcagtgtggtagtgatactgaggtgcttgttcctggttgggggaagagtattctttagtgtctatagatgtcaaacagtacttgaactgaaactgtctcagtgtacaccatttactgtgttggtgtacatctttagttcatattcgaacaccagaagtagcgtaagtacacactgtacactgtagcacattatcgtacaagatgtacttgggctggtacacacatgtacaagtagagcgaacacgttatgaggggtattcccacattgtctactacaagtacagtacaggtatttgcacccactgactctcccattgactctcaacttctggttttgtacatgtaattgtacctctgccggctccatgtttgcttggaatctggcaatcatggggatgccaatctgatctcacatttgtacaattaagggatattgatgatggggcctggacagcacaagtatgatggatctctgcattttataaacatcataaacgtggatgctgccatttcaatcggcttctagctgcgttctacagtagataaataatttttcaagttttgtgagaccattgaagtagacgaatcgccggctttcatctcgattgtttctatcgcattgttgtatcattttggtatttgtagttactgtaaacccagtgctacatgtactgtatctctacttatacagtagttgggtaattggaattacagtatactgaatccaccacagtcaacgggactacctaaaatacacattcaggatagctacgcttctagatactgtacacgcacgctctgtcaagcaaaaaaaataaaaataaaataaaactcgctatcgcatttttcacacatttctcctacaaattgttcattataagtagcgatcctccctcctggctggtgaagatggtcccattcagtcaaggcaacctaggtttcaacacggttgtgggctgcacatgacagaccacttcaatttggccttagtaagcactaatacgaaatgtgaagacaatatatattccaaattttgtccactaattgatttattgcttcaattccccccaaacctgccagattactcacttatcatcgcccctcaatgaacctcattttataccctaaccctaaatcaccactggcggcaaccttgaaaacatccatcaccacttcctacgagtagaggatttgcacgacatcacaatcaacaatggacgaaaacatgacggatgcgactaagtcgccgtcgcagccttcgtccgtggacatgacgtttgtggccaattttttcgatctcgatgaggcaactgtgcagcagctacctcacggtctgtctcacaagctggcgtctcaggcccagcagttcgagcttctcaagagtgaaaagatgatggcggaggtgaattttggtgagtaaaaacaatcaagaaaagtattgccgaaactaaggtgctactcgctctcaacagaaactaacacagaacaatcgacacacagtctcaactcgaaactgaagactatcaaatcccaacttgcccaggccaaggagaatgaggatgaactctcttcggagattgcaactctcaaggccgaggccaagtcgttcgaggaggccaaagagtccatggcctctgcttctgagcgatcaggagcagttgtcgaaagcctaagaagcgacattgcgctactcgaaaacgaaaaacgacgtcttcttgagagcctggaatctcggggaggtgactttgtgtctcttcgtgcggatctcgaggctgcacaggccaagaacggagaacatcgacgagtgattgtggagctggaggcacaggtgcagaaggaacatgcggcagtgctgcaggcgcggttcaaggaggagcagctcaagcaggagacacagcagctcaaaaagagtaacgcatggttggacgaggagctcaagaccaagcaggaggaacacagcagctttcgacgagataaggcacagctggtggcccggttacaggccgaggtggagcagacggcagccgagcgagatggcttacgtgcttctcttgacacggctcgatcgagcaacaacaccgtgtctgccaaggtcgatgagctattgactcgaaacaagcagctgcaggatgcagccgcgttggctgaggagaatttccgacgagaaatgtctgctcaaaaacggctggctgagctatacgagaagtcagcgtcagatgccaaggctcgagtcaacgagctggaaaatggaggaaacgtaaagctgcgagctgcagtggaagaggagcgggccaaaagtgcgtctttggaggccaaactggaggcggtcgagaagcagcttcaggagattcatggatcctcgagtacatcttcctttgctaacggcacacctgctccttctacgcctcttcggggaggtctcattcctggcggaggaaatggtactcccttttccccgtctgccaaaattgtttccgagctcaaccggggtggaatctctcttgtgcaactctacgctgactatcaggatgtgtgcaagcgtctggaaaaggagcgaagccgaaacgacgagctgcagagcgactttgacagactgctggaggaaatggaacaacacacgcctgccattctggctgagcgagacgagtgtaagcgtctggagggtgaactggtgcagttgagtgtgcagctgcaggaggtgtctgagtcacgtgaaaagctggctgcaggcacagaaaaggccgaggtaactgctagagacggccagcgcgagatcaagctgttacagcagcaacttggggatgcctctcggcagatccagcatctgcttgttcagcagaagatgcgggagggcaactctggccctctgactgtggctgagcgagaagctctcaatggcatgctttctggcgagctggacgtgtctgatactgataaagtcatcagtgaacgccttgttgtgtttgctgatatcattggcatgcagaagcagaatgagcgacttcttaaaatctccagggagcttggtcagaagctggaagctaaggagtctgaaactcgagacaagatggccaacgtggagtctgcagctatacaggaggcgcacgatgctctcgaatctgttgtgggcgacatggagcgtcttcagagccgattcgaggctgtttcgagagaacgagacatgttccggcgtattgctggcgacaaggagaatggaggagttggtgctaacaacaatgccgtcactgttacttcttcttctgcttctgacggctctcttgaggctgagtggaatgcttataggactgaaactaacgctacaatcaagtctctcaacactcagatcacgtctctgtctgatgagcgacatagtctgcagatcaacctgtccaaggccgagagccagtgtgttcttcttggtgagcgtcttcaaaatctcaaaacgaacagcgagactactcgacaggagcgagaacagcttcgacagcgagttgagcagctccaagaggccgccactcgacaagaaattcgaacccaggctgccacagaggatgtggtgtctgccagatctacctgtgatcagcttcgaggagaagtgtccaacttacaggccgagaagcgagtgtggaagtctattgagcagcgtatcaccaaggataattctgagctgatggatgagaagaccagactgaacggtgttatcgcccagatgcaggttaccgaatctgagcggtccatgcaggagggagagtctcggaagcgacttgtttcacagctggaggctctggaacagagcaagagttccacagaaaagcagctggaggaggcccgaggagagctcaaaaaggtgtctgatcgacgagacattgagcaggtgcagtaccaggagcgagtcgatgccctcaacaaggagactggagttgctcgggagcatcttgccgtcgccaaggccgaagtttcttctctcaaggagcggaacgcttctctggagagccaggtgatatcgttgactcaacaggttgctgtccttcagcaacagaatgagggcgatgaggctacccagcttggtcgactcaagagtgagcttgtttctgcccagaacgagctgtctactgccaaatccgagcttgctgctgccaacgctcaggttgaacagttcaaggggcttgctcaggctgccgaggaaggtctggacaacatggtggcttctcatgacgagtacaagaagtcgattgaggcacagttggagacccaaacaaagtctgtggctggtctggaggagcagaacaaggtgctctccgaggagctcaagcttgcacaaggcgagattgatgtgttgcaacgacaggagggagagcacatcagtgctgttgtcaacgagaagaaggctctgctatcacagattgagtctcttaaggcagagacttccactctgtcttctcagactgccgagttgaagaaccagcttcaggagaccgccgtcaactgtgccacttaccagtccaactatgagactgaactggtaaagcatgccgaggctgccaactctctcactgcccttcgatctcaattcaatgaggtcaagacccaaattgcggtgtctgctgctgaagctaagtctgccaaggaccagcttgagtctgcttccgactcctgggagactcagaagactgctctcgagggggaggttgccaagctgaagtctcgagtcgacgatgttatttctcagaacaatcttcttctggacagtctcgagacccgaaagtctggaggggacacttctggagaatccaccactactaatactgacgttgtcacttacttgcgtcaggagaaggagatcattgagacccagcatgagctggctatccaggagaacaagcgtctccaggctcgactagatcacgtgagtgtttctctcgatgaggctcgttctgatctggagcgactcaaggcctctattaatgatggagccaagtccgagagtgctcgtcaggagcttgccgacaaaatggaacagctcagtgtgttccgagagtccaacaaaacccttcgaatggaatgcgaggcttccaacaaggaggtttcacgtctccaggctaccatttccactctggaggccaacttggagccgtttgagaaccagctgagtgaccgtgaggccgagattgaggctcagaagggcgagatctcgctgctcaaggaggacaatgagcggtggaaggcacgaactcagcagattctgcagcgacacgagcgtgtggatcctgccgagctcgaaagcgccaagaaggatctcaagactaaggagacagagctcgaaagtgccaagaaggatctcgagaccaaggagacggagcttgaggaggtcaagaagaccctcgaggcgaccaagtctcgtcttgaccgactgaaggaggaggccagccgaaagctcaagcatgcccagcaggccaagaacgctgctcagcaggaacttgtgactgcccaggctgcgcttgctgaagctcagaaggccggatcggctggttccgaagcccacacagctgaggtggagactctgcaacagcaggttcagaagctgacggctgaccttgaacaggctactgccaaggcctacgagacccagacccaactggatgctgccaatgcgcaggttgccgagggtcaatccaagctcgaggctgctactgcacagatcaacgaatcgcagtccaagttgcatgctgcttctgccgaacttaacaaggccaaggaggaggctgctactactgcaagcgagtttgccagctataagacgaacgccgagtccaatacaaatgctgcagaagctcctacagagcctgttgttcagcagcctgtggtccagcccgctcagagcgaggacctcagcaatgaactcacttctgctcgagctgagattgaagctctgaagaaggaggttgatagtgctcgatctgctgctgccactgttgcagccgaggctgccaccaccaaggaaaacgatggtgaaggtaccaccactaccgtagtggcagacgcttccaccgagacggctcccaccgtggctacttccgccgccacccaggcggaactcgaggctatgtctcagaagattgcagctcttgagaaggagctggcccagaaggaggaggagcttaagaacgctcctgttccggaagccgtcaaggcccagattgtatctcttgaggagaaggtgactcagctcgagacggagaagaagacagttgagaccgaacttgcacaggttcgagaggagctcaagcaggcccaggagactgctaccaagacgtctgtcgaaggcgctcctcagtctcctccttctgacgaggcctacagactgcaagtaaaggaggagctgttggcttcgatccagaaggatcatgaggaggagatccagagactgcgagcccagtggcaggcccctctggacgactggaagactagaatccgaaagcaggccaacgacaaggtcaaggagaagatcgacgccatcaacgccgagtggaagggtaagatggatgctctgagcacagagtgcgaggagaagctcaaacaaaaagatgctgagatcaaccagtctaaccccgagtttcaggagcgactcaaggcggagatagagagtgctcgaaactcagagcgaaagatggcagagatgcgtcaaaagctgctcagcagtaaggtggccaagctggaggccgaactcaagagccaatccgagggcggcttggctggtgtgcccactgctcctgcctccagcatctcagttcctggtatggctgctcgaccccaaagccgaattcccggccctactattcgtggaggacgaggtggccgaggtggacttctgcagcctcagcgacccagcattgtgcgaccgggatctattcctgtgcctgtggctggtgtcaatccgttcgttcctggttctgtgcctgggtccaccactgctcctgctgctgagtctactttcaacaactctggtgttccccctggagctcctactggtcctggaggaggatctgccaagcggcctctttctggagaacagcctgatgctcagaagaagcgccgagatgattagagaggatgggagctggaggaggatgatatggaatggaagggggtgtattattaatgtattgtttaatgaaattgtatatttgtaacatgtataaacatgtatagataggcttcaagtacatactcgtactcgtacatggaataaatgaatattaaattgaatattgaagagataaattatgcaaaggagcgtgggcctgtgacaacgggacttgcttgtaagacgatggtgtacttggacagcgagggcgagaatgtatgcctttcacaataaaacacgtgcgtatatcatttcttgatacaatgagtgacaatcattagctagtcgaactgtttcaactttagtcggcatagttcacgtgctgtagactcttaaaaaagcagagctgcgaaaccaaccatgaccactgttccagcaacggccagagaggtggctccgttggcattggcaggggcagacgaggcaggggaggccgaagatgcggcgtcagacttggaattggatggagccgaggtagagtcagccgtagctgctcttccagaagaggcggctccagaagaagcggtagcagaggccagaccggaagcagagccgccgttggacacctccttgttgctggcagcctcagatccgctctgaggggtgatatatgttcgaatggggtggatgtgagagacggaggagtctgtggagccatttccagctgcgacggtggaggtcaccacagaggctgtagtagtgacattgatggcaccaggggtgatgatggtgttaacgggatggatgggggccactgagttgactgacgacatgttgtaactgaggtgtggaggggttgaacaatggttatgttaattctcgtacggtataaagagatcggcaacacaaaataatgttgccagtacaagtacaattcgttaacccgcttaaacgaaagttaaaagtgttcggggaagggatattggaagccgaaagggtgtgaaaataaaaaattgaaaataaatggttcactaacacaccacaatacacacccgacacttttttcttttattctaagagcaatatccgccactatttctcgagcgcaatttatcttcctgcaccttaagcagctgattgtggcgattaaactactcaattgcatatatgtcgatggctggaaggaggttggaggtgggcaatttatttatgactacgctgtagaggtggtggtatattatcgcagacaaacaatctcaagattgattgatttatggtagctcattatttcactcaactgtcaggaaaacttcctctcgtgctgtataagtagtgctctatcgtctactgtacccacctttttccactcccaatatggtatcatgttgttggccgaaaacaccagaggccactgatcttcacagaaaaagtaatgactgacagtacagtaacgttacaccatgtaataggagctacgatgaatatgagtatgaatatacagtataaagtaagatgtttgttttaatacacactgcccgtatatatacacattgacgactacaataccttcaatgtgcctctctttccatacagccggttatctgcatctcctgatgtacaggctacataattcaagtgctgtaccgaaacactccaaatatggtcctgagataataaaaccttaatcatcgaacgaaggggcagaacataaagaacaccaacgacaccacgggtacccacaagtacacgccggcaggccctgttcaatactctaataatatatatttgttatacgttgtgttcattttttgtgtttgttgctatccaaaaccccggactctatttacatgtccttcttgatcttggaaacgtgcggtgcgatggtcactccagcaactaaaacgccagagaggtactctaacaccatcatgaacagactgagaccactggcgatacagtagtgtgaaataccagtgccaatgtcgagccatgagccctcatcgacaaccagatagaagaagttgagtgtcagaatgtcggagacacacaagaccatggagaacagcgccgaaggaggaactccaagcttcaggttcaagatgcccagacatgcagataggacagcaaacggcaccaagatcttgaacatgagcagagcacccatggagaaggggtcaaatacaggaatcaatcggtacacagagtccagagagaaagacgaaatggaggcaatgtttccaataccgaagaaaccaatctgggacatgaagaaggtgaacaaagccattcggaagtcaccaggagtaagatcagcccgggtctggggtgtcactcgggcatctcgcatttgagtctcaagctcaatccagatgacaaggatagcaaagaaacagacgtagaagaatccctcccacgagatggtgaggatgacaaaggtaggtccaaatgccaggaagatgatgagcagacgcagtctgtagtccttggcatcagatcccaggaagtgtaagaagggcactgcaagggagagaagaagagagatccatcctccaacctgagaaaacagaggaagaccgtttcgagcagtaagagactcaacggactctcgagtgaagtacatggttgcaacaacgagaaggatctgagcaaagagaacgcaaacagtggaggccgcaagagcaagttttcgctgcagatgaatagtgaacaccagtccaatgaccagcatgagggcaccagaaagcagaatctgctcaatagactccaccttcacgacctccagaagtgtgaaggaagacatgattgcgcacatgacaacccaggcaagagtagtgggccattctcgcttggcaacagtgaagttgtgcacaaagggccacagagtagcgagtccgaaacaaacagagaatatctctcggtggaagtacccgtaaacaatggcctcaaggagaacaagagagagaccaatgtccaaaatagcagcaagagctggagccttagaggtagatcgtcgtgccagaatggagataccctcggcaacagcagttcgcctctgcaagacagcctcccagaagacaacaggaaagacagcgtagaggtggtagtggagaggagacttctggaaaacgaagaagcctgaaagaatggccagggcaacgtaggcaactcccttgagaggaagagacgtggtaaaaggcttgtcggactgaaccacgaaggcaagcaggtaagagcagaaggcaacagcaatccatccaaagaagcctatggtcaccagggttcgcaggaacagccaattgtaggtctgaaggtacttaaggccggtgatggcatatgtcatgagttcctcagaggcaacaatcgactcctggtcgagtccctgggcaatcagctcgtcgatatgggccagtctctcatcgatggtctttccagcatcagagaggggagggtaaggcttgaaaatgatctgggaacccttctgctgctcttccttgactaggtactgctccacaagagcaagagcgttgtttcggatagccagagccttggtctcagaagtagcgttcacaaaagccagaggaagctctccgacagagttagaggggtagttgagacccacaaggtacgacataagagaggcgatatcagcctggttgacgtcatttcgcttgacaggcagatcccagacctctgagtagtcgtcgtgattacccttgtcttcgaaggcggggattggcttgttaactccagctccccaagcgatgagaggagttcgagtgttatcagggtgaccgtcaccgtgtgaaccccaatcggacatgccgtgatcggccgtaaacacccaagcggtctgttcgtcatcgttgtagaacttgttcaccttgtccaccaacttctcgatgttctcatcaatgtacttgatgttatcgtaatactcagccgagtagggtcggtaagaatgaccagcagtgtcgattccaagcagatgcaggaagaagacggtcttgtcggatctcaattggtcgtccagagtcttgttggtcttggatttatcgaagatctcgtccaggtggtcgaaaacgaacgcgtcaagctcaatagaaccctttgtgaaatcctcaaagtcgtggccatacatgatagcatcaattcgcgattgatcctcggctccatgcttgaacatgggcaagatatcgggagatccaagcgagtaagtgtgtctggactggttgaaaacggagtcaaagtccacagggttttccttccatccctttgtgacggcactcacgtcctcgtagaagcctgcaatgagcgccacatggccaggacgactttctgtgggcattcgggtgtgtgagatgccaaaagtcgcgtcggacatgacctttgaacgcaaaaaaggagccaggtactcggactcgccagttgtgggatgtcgcaccttctcaaaggccttgtcggctctcagaccgtctcccacaatgaggaacagccgcttggcaggcggagtagcggtactctggtgatgcttcatgccatggatcaagggcgacacaaagtagatgtcgaagattgaccacatgaaggccacatggaaaatgactcccaccagcagcaccagcttcttgttgagcgatatcatcttatctgggcaatatggtgatttggcgaatcgtcaagcacaaaaaggaccttagtggtgaatgctgcatgaaccacgtctacacgtgggatagggttgtaaggggtcagatgtggggtgtgtacggaaggtgctagcagaagaaccagcttgagccagtctagtggatctgtgggaccccagggacgtacattagattatggatcatcctcttttacatctaagtaagttgattcagtaggctacgtgtcaagtgaaaaaaacacgcgtgttccacgaaatcagagtattaggttctgttgtacttgttctgtagtcccacttcgagatcggaaatagaatctaaatttaattgcgtatatacggatgatttactagaatatatcatattaattcgaattaaattgagagaaatgtgggagttgacacaatcgttgtcagagggtcacatatgactttttatatacaatattttgtattattgactttgcaccaatgccatacagtaaaacatgtagagacatcacttattatctcttgttcttcgtaatgccagtgcattcgtataacagctacaagtacatactgtacagtagttgtactcgtaaaggacatatacgtagtacacgttttagttgacgtgtcgggttgcaagtgcttgtacaatacttgtatcatataaagcaatatgaaggcctaacgaccagatggaattcttactcgaagagcaaacggctgcacaggtacacacggttcttgttatattttttacgtatgacttttgttgtacgcaagataatactgtagttcaagtacagtagtttgaaagttactgtataattaaatgaatgtatatgcaggaaaaaacaaacgatgttgaacaagtagaacaccatctgactggcaatggaggcgaatataacatatctggggcactctgttccactcccactttacttcggaactaattcgaatcagatatacttgtaccttccagcatattgaaaaatacacccacagcccttccatgttagccactgtcgagttggctgaatttgggacactgaccagccactgagagtataagctgccacccacccactactgtatatagacacgttacaaaccatagagaaaactcgtcggtgatctgaacaatatcatttacttttgtaaacacttgccaaacagtaacttatcctagtgtatatccttccctacaaacacttcccacacccccattggtcccccaatataacaccccacataatcgctgcatatcactgagactaactacaagtagctaagctaccgcgctcattctgtacagggctgatatctgatacataaacaccacacatggacgacattatgcaacacaacatgtcttggaaagagcaagctgagcgtttcatggacttcatgtccaacgcccccacggcctaccatgcatgcgatcttctggcccaagactttgatgcagctggatacaaggagttgtatgagcgagacgaatgggacctcacgacacacaataagttctacgtgcgacgaaacggaagcgctatcatgggattcgtgattggtgagaattggacgcctggaaacggtgtcggagttgttgccacgcataccgatgctctatgtggccgagtcaagcccatcagtatcaagcagcctgtggatgggtataatttgttgggtgtggctccttactctggtgctttcagctctgtgtggtgggacagagatctaggaattggaggacgactgattgttcgagacgaggcttccaagtccgtgacttccaagctggttcatgtcccttatcccattgctcgaatcccaactctggcaccccatttcggagctcctgcaaaccctcctttcaaccctgagactcaaatgactcctataattggtctcacatcgtctaaggaagtcaaggcacctacagatgaagagaagcagtctcccatggttggaaaacactcgatcgacctgctccgagtcctcgctaaacacgcacgcgtgccagtgaaggacattctgcaggtcgagcttgagctattcgacactcaggaccctgtcattggaggtcttaaccacgagttcatcttctgtcctcgagttgacgataagctgtgcacttacactgctgtgcagggcttcattgccgccaagcacgacgacagagctctcaacgtcgttgcctgctacgataacgaagaggttggctctgggactcgtcagggtgctcagggagatttgttccaatgcattgttgagcgggtcgtggctcatggtatggactcctctgtagccaaccaagcagcggagtacactcgacagacctacgccaactcattcttggtcagtgctgatgtgggccacgctgtgaaccccaacttttctgacgcataccttgagttccacaagccgcagctcaactacggaatgacactcaaggtatacccgaatgctgctaccacgtccgatgcagtttccatggctttgatcgaggagattgctcgacgaacagacaacaagacccaggtgatgcatactcgaaacgacactcgtgctggaggaactctgggtaagttccttgcctcagctacaggtatgcgagcagtcgatgctggtattgctcagttgtccatgcactctatccgaggcacacttggttccaaggacattgccctgggtactcgattcttccgtgacttttactcctcttggtatgaagttgaccaggagtggaagaatggtgatatttgacgagctacagaagtaataattataacatctacataactatgacatctacattgtattagtatgtatcgtgcaattgtattataataaatatttctactttcatctcagctcgttgctaatggcatcgtaatgctccagagcctcggcatgctttctggtggccgagtactccttttccaacaccaacgcgtcgatttcacgagcctccatattagcctttctgtaggtggacgtagaattgaggatgttcttgtgagcctcattggcctccattcgtgcctttcgatactcgatgcattgcaagtagaacttatccatgtttttctggtactggttgaactccctgagataccgagccaatgcggtatctgcatcttctcctgaattgtagctgaaactgggaggcagggggggatcaatgaattgagcgttgtcggtagcaagatcaatattgagctttgtgtaaggcgaggcaccctggggtctgaaggctgacgaggtgttggtgttgacgggctcactggttgtgtttttagaccgtctgaaccgaccagtgctgttgttgtcttccccaataggtccccccttctcagttttcaccttgtccccacccatctgatcaatgttgtttcggatttcgtccataccaaagttgccgttggtctcgttaaacgggtggatgttgttgatatcaaacaggggattttgtttgaaatctgggctcaccttcttcgacggaggagcttcttctgcgtttcgaggagtgaagggcgttctggaggcatgatcggaatcagaagtctcctccatgtacggctgtctgcttctggtataagttcgagaggtcggaggttttcgacgtcgatgagcagccacaggccttcgccgaggtttagcttgaggactgtcactaccaagattgaagttgaacatggaactcagcacgtccttttcaaatggtgtagagtcgaacagactggctccaaatatgttgccctgagcagcttcatgctgatcattaccttcaaacatactggtatcaatatcagaatcagacgatgaagagacatcctgagcatgggcatccagatcatcactactgctggtttcctccccgaacatgtctcgggctctctgagactttgccttgctctcattgatgagttcttcacgtctctcctgatccttacgtcgctgtgcttctctagcaatctcacggtactcgtcaggagacagctcttccacttcgtcgtccgttccggtcaaatcaacaaacgtgctattgaatccaaacgggttacgagtctgcttgtagttgggatcaggaaggtcattctcagagaaatcactttcttcttcagactcttcttcctgatcctgtccaaacaaaaagctatggtcttctcggaacgatttgctcgcaggagaaggctcactggtcttcatatcaggcatggtgaagttgaaagagcctgaagtcggtttgttcttaggcgggggctcgtcgtacatcttgaacttctctcccttcccagaactgctatgaggtgctcgttgtcgctcaaagttgaacggtgcttcagttccagtcgtatccttctcctgctgctgctgctgctgctgttcgtaaacaggcggcttaacattgggggtatctccgggtctatatcgttccccagatgtgtaactgtagcctgtctttcgtgtgaagcttgggtcgccagctgtcgatttgaactgcggaggtgtcgaataagcctcttcaaactgtgacggtttcggcttggtttcctgcttaggtgtgggcctgggcttcgtttcagctcgcggttcgggcttgggtttcgtttcagtcttgggtcgaggtttggtcttggtcttaaatttgttgctgccgcttccgctgggagtgctgtcataagcgtacctgttgctgttgtctctctgggcgtagtagttataggcactgctctttgatctggacgatttagaagatctgctttgctgctgctgctgctgcgggcgtccataggctccataaaagccagagtaggcccaaccgctggccccgccaaagtcggagaacgagtcgtcccaatgatgctgtgaagacgtccatcctcctcctctggaactgctagtaggcgtacttccataggagtagtaggcagtagacgaggctttggaagcggttctccatttggcctcagcttctcgacgggttttggcatcattcaaaacgttgtaggcatcattgatgtcctggaacttcttggtggcttcgtctttgcgatgtggatttttgtcggggtgccagaccagagccatcttacgaaacgactttttgatgtccatttcgctcgctccgggcgacaaacccagtgttgcaaacgggttgagggtggacatggcgcgttttgggctgagaaagaggtgtcaaacttgtggtgtagttatagggtgcgtctctcttggggtccgtctccattaaattattttgacttcgatgatgcaggatatgccattatagttcgccactgtaactgaagatctgtagaggggatgtcgttttaggggaatgagatatattttcaagctgaaaagttctagatatcgcagcctcaactagttttgtatttatttattttttgcttttatccattccaacgactctcttagcgttaaaaaactacctccatcgtctagctagttgtcatggcaacggcccgcctgcagtcagccttaccttagctactgttacggaaactacttgtagccatacactacagtacacacacattgtgcgtgcgggcccaggaggttcgagaacagacgctggaaaacagcaacaaaaacgtttcatcatgttctatggacatacagaagcgtatatttgaagcgtcttccacttctcaaacatatcacacaatgcgttttaataaaatgacttacctgatttgcattatgtgacttccgtagctacttgtcccggtacatactgtacttatagtgtactacacttgaaagtgtcaccaccaaacggctctcatctgtcaatgttgtggcaagctactgcattgacttaacatagtccctggggctccaaaaacgtcacagtaccgcttaattaacactataccccaatgcctagatatcgtcatcttcagtacaagtatgatatacgtatgctcactcactgcacattcatagttaaatcaagcaagcaatattgggcacaaaatggggtttctacggcagccataaatgcagagtgtgggtattttgtgtgcatttttggtggctaccaatgcaccatgaagggttttttctttctttctcgccaccgtcctcccttaaactccacaatgggattttctagaaacaggtcaaaaaaacaggttgagtccgtctcacttcaattatgcgaggtggatcgtaaacatgaaggcgcgtagggtagaagtcagaataattcaacacgacgaagtacaagtacttgtagctcccatggcattacccttgtcttgtgccattcgtacagtatcaaaatgatctgcttggtctgggaggttctctgaacaagtactggtatatataattttatgtcaaatatcacagtatgggtttcctagggctcccctcatggctatatggatgattacatgagaaaaaactacaatacatttttatagagagaaagtgattgcgcaagaagactcacaataacatgaactttcgaatgataccaaatacgacaactctacaacgcttcatcacttgctgacatctgaggtgctcctgctctaaccctccctataggcttaatctactacaaactgtacaaggccatacttgtacttggaatacagtacattcgagtagctatactgtagtacaagtataagtaagtacatggagtaaattcaataaattaattaaatatgactgtagtaaccatctacaaactcacatcatgggaagccatccaacatacatcagagagaggttttcggggttgatggcgtcctgaataagatgctctacttctccagaaacactcaatggtaacgcttcctgaggaacaacaccctggatcttcttgcgaacgatactcagagcttccttgggtccagatgcttgccttcgaggtcccacagagaaacctgagtcaccaccgcccgacttccagtcgttaatgggatcgtgaacaaacgactccaaggcagtcatgatagtgtactcatgctgtcgaagaagagccaatgtagactcacaagatcgtctgaaatgaccctcgtaaccggtcacgcccattgcatcgaccaggttctgagtaagacggaaggggaccatttcaggcttagttaaactgagagccttctcgaacaaattgtcgaaatcaacatgcatcactcctccgtcacccagtagcaaaatgttctccagatgccgatcacccagacccagtacatagcctacaatggacatgacggccagtgacttggtgaacttgtcacgagctcgcagccatttatgaggctcactgaacttctccaagaaccaacggtaaagctccggttggtagttcttgagaatcttcaagaagaccttagcaccggtcttctttccccgggaggctccatactccaactgctcagtcagagtaccccagtcaatgtcttcatagaagcgtagaatgacactcttggcagttaccgaaccagacacccactcaatcaaaccacaggagtcaccaagaggagtgacaaagtaggtcttaatacccagagtgttcttagcaagcagcttgtcaaccaactgggtgatttccaacaatcgggcatcctttcgaacatcatccttgtttttcaataaaacaggatagtctttgccatcagaaccaaccaaggtgatcttgaaggggtgctgaagggatcgcataatggtgaccttctcacggacaccgataatggaaacaacttgtgcattcgtgttggacatgaaatcctcacaaggtacacacaaaggacagggaactaacttggggttgaaaccgagatccttcgtcacgcgcacctgactctgttttgaattgtatcgagccctaagtgtatttctcagtgaaagggcaaacttctccgacttatcgaccgtgtttttgttgatgttggggttctgcctgagagaccgaagcagattggatcctcggctttttcgagtagcattgctcgactgcgacaaagacaacaggtgccagatggttctgtcagtgtacttttcacagacgtgaatcatgatgctgttcatgacatcgagggtggcagcattgtccatagcaattcgagccgtcatctgagacattccggcatagaacgtagacgcaggaatgttctgatgcatagacgagatcaacgaattgatacgagccaaagtaccagactttttaggagactcttcatcacccatatcaagccaggcactcagaagcataggcagagtctcagtagcatacttgttacccagctgtagagccgacactagagctgtgatcatggtgagggtcaattggccgttctcgtattcattcaccttgttatttccatcctgatcctggatgacaccatggtagaatcgtgccagctcgtagtaggccttctcggtcttggcgagctcagtagcagcaatgtaggttttggaagccaccgaaaaaccgacatgtccactttgggctagccaaccagcatacagcagagccacctcaccatcgtgaccacgatctttctcaagggttcggagtgctccctgcatatctccttcctgccactgaagctgagcgtactccatacgccctcttggcgtgtagaccatgccttgaagagcagctgcagtagccagctccacacgacctgcatgacgatactgggctgcgagttttgtccagatgtgggcaacttccacagtggcgaaaggcagctttgagacagagaaaatgaacttccgaatatctagaatgtacagctggtctgaaacgtcctcaagacgcttatcgagcgcctcagaaatgcttcggtgatcctgagagaagcactcagcaactttggcgacagattcaaagtcagcaagagcatgtagccgatcaaacgacagcgatagggtatgtgggttgacgagatctcgcttgacgaagtttcgggccatgcgaatctgactgctgacacagtctgtatccccatctccaaaggcaatcatagcctgggccatgcaggtagagtaagattcatgacctcggctccgagcaatgtcacaccattctctcaccttgtcgacattacccaaccgccaagcagcctcaacagtgatgtcgactgactcattctcaaaacagatgagactcttctcagcttcatgcaacagagtctcataccgatgagcattgagaagacagttgaagtactgctttcccttggggagatggaaatgctccacagaccaacaactgagagccagatcccacttcttgagcccctcatattggtccacctgctgctggggagacagagactccatcttggtgacaataccggcaagcgcgtccgtatctttcatttcagaatataccttgaacagcttctggtacacctcgtctttcatctcgggaactcgacggacagcagtgtcgagatagagaacagttcgcgaataactctcacaaaccatggctttatcaaccagctgctcactgtcgatacgttgcaaaaaggtgtccacacgcttggctcgctgcctggtagcattcaacttaagatccttcttatcagcaggatcaccttcttccggaggagccagcaaatgctgcatgtagacaataagatagtccaccactcggaacacagttcggtagaagtcatgagtcagcgaccgagacagaatctccgtaatggacaggttgagctccttccgggtagctgtcttgcagtggaccaccacacacgcgaacaagtaggggaacagaaaggtggcaatctccggagactgcttcatggttggcagcaacatctcgtagatctccttctccgccaaagagccttgctccatgatcaagttagtgagccaccgacagtaattgatgatccagtcctcatagggctcggagcacactggtcggtccttcctcttgccagtgtctttacccacgtagaacgttgacatcgtgaggggagtgagaatcaaccgagtttcgttatcgatgcgactccattcctcctttgtcaactgctccttcctcaagatctcctgaataccaatcgcaatgtactgctgtgtctgcacctcagtgctctgagaataacattttgagagaacgttcgtgagtaggtagatgcaaaattcacgacgctcagggccagaccaatccacaaccacaggatgaggcggcttctccatattgagggtgcgtggagaattcagtacgccaaggttcacacaggccaggtaagcaacgtcgttggattgatgagcaaactcctgaacccaacgaaccaggagagcagcagcaggtcgcttgtcggactgtatcttgctgatgttagtgaagagatgagtctgcagacacattagaacccgccgtgcgacatagacattatcatggcgaggggtagatatcaggtaagccaaatgttcatctgcatcttccttggggtgctcagaaagtgcaataccactcttattgataagctgtctatcacgggagccaatcaaactgagccagccagtgaaaagagaagcaatcaggtaatgctcttcgggaaggtacttacccaaacagattaacaactccacacaggacgatctgagctcaggaacctcaatggcagactgaagacaaacaaatagctgcgggaaaatggccgagatctctttggaaacagacagtgtcaccttctgaagcgcccgtaaagcactggtcttctcatcgacggtatgagggttctccaaaatgttggccacatgcaacataagggacaacatagtgcccttgagaagtgattcggggttagtgtttccccaggttgcaagcacaccgagagcagcatcaacaggctcactatcggcctcttcccaccgacacaagatactcaatagcactcttgatctgacaccatgctcagcatagatgtcgtgaacgtcccgttgaatacccgcccagtcaagcatctccttgatttcgccagcgtaacgtctctgatacttgataacggccgctgcaatcacctcaggaatgtttcgacgaacaacctccgccactgtggtagatgacagctcagcaagatagtcaatgagccctcgctcttcaagaacgccaattggaaccacataacgctcaatcaaacgggacatttcgacattgctgactccaacacacaccgccaacacatcacacactttcttgcgtgctgcgaatagtccaataacctcccaaaactggcccaacaagtccagcggcttcacctccaaaacccatgctgcacccaccacagccgcaactgctcggcttcgaagcagctcatcatcctgtgcaaagtattcgaccagactgtatagagaatagctcagagtagcacccgtggccttcttggcagcagcagcccagtatgaaatcttgtctgacggatccatggtgtcaattacacctataaattggggatgcgaggcgaaatcagccaggtagtcaggtgcccgtggatctccagggttcttctcaatccaatcaacacactcatcaatatctgcaaactccagatcctcagtctcagccgtagtgtatccatctgttcggtcccatccgttggtgtacttggtatctccaacgattgacgtagtatcccagccccagagagaggccgcactgagtaggtgacccaaccacaacgggttggggtcagcatcagctaaaacatatagttcagtccatgctgccagccctcctggaggcggatgtgtttttcccttcaccaaaacctccaacaaatcataccacaagtatctctcatcgtcattgagagcatggaaccatggcagcatacggtcaactgcatagtctcgagcatccacatcaaatgtcaagtatgatatgagcgcaaccagacaacccgggtgttccttgtactttgtggcctcctcgtcgactctcttgagtagatccttccccataattcctccccatccggaatgttcagccatcttccacaccttggccagccgtaggtaagtgattcctccatatcgatccatagttcggaaatacgatgctcgggtatcgtaagacgtgtactcatcccccgtcagtagatccatccacagatcctccacctcggtcttttgtttccattccagcgttgcctgcaccacctgtgctattctcgttcgacatgtctcagcgtcctgtcgtaaagctgcaatagatccctcatctgtgttagtcaaatgatagacagcatacctcctccaacccctcagatttactcacgttccaccgccagagcggcatctatgcgtgacatggcgagacttgtgaacgcgtggacaggttctcatgcgcgatcaaaactactttacatcatgcctgccagtcgtgtcaatttgccacctgactaggaagctggggggcagttatatggatatagtaggaagactttatattttcaattacttatcaaattatctattgaaagatacttctactgacgactacaatgactgaacacttctaaatattacaaaatctcatcaaaaaaagtcccaaacactccccacaatttaacttcggattcttgcatgaaagtttaaaaaatcaaccttctaaaagaccctgatcacatctccaagaaaaaaaatatacatacaattgacgagcgccatgagaaacctccaatgtgtacaccggggtattatcaaacccgaatcagtggaggcacctgatctcaacctggtcaagaccatttatgaccctctttcagacgccatggtcttcgtcttcgacggcttagacaccgttgaggttcagcagttctcaaaaaccgaaggtacacaggtatgggcaaacttccccgtcagtggccacgtccttgcatgcgactttttgtgggagtcgcagacgtgtgtcatcttcctcagtgacggaaacgtttacagtgtggagcagggagatcaggtcatcaacctgggagaaatggagggagtggagagtgcagcatggtcccccgaccagcaagtagttgctctgggagccaaagacaaggtccttgttctgtctagaactttcgatccgctctcagagactcctgtttcagtggacgacctcaaactgtccagacatgtcagtgttggatggggttctgcagacacccagttccgaggacgaggagccaagagagatcccacagtgcctgagcatgtcgatattggtcacgtgactgaatcagatgagtccaacattactctctgctggagacctgatggagagtggcttgcccagtcctcctgtgacgatgtagagggaggtaagcgacgagtcgtgcgagtttactctcgagatggtcagctcttttctgtctctgagcctgttgatggtcttcttgatcttgttgcttggggaacttcccttatcgcttgtgttgccaagcaagaggttgttttctttgagcgaaatggtctccgacatggagggttccacattggcgactttgtccctattggcatgcaatggaactctacgggtgagattctggccctgtggtcccatgaaacggttcgactctatactacaaagaactacagatggtacctgaaacaagaggtcgtttctcggcttcccggaaaccccaagaccctcacttggcaccccgagaagccccgaaccatcatcatcaactatgacgatcacgttgagatccacgaatacacagacactgtcactagcgagcctgttaacggagtcacttgcgtcattgatggaaagctgcttcttgtgacacctctgaaactggcctgtgttccccctccaatgtctagagacgagatccacatggaggagaacatcgttgccgtttcttcttccgcatcacacattgccgttctcacaagagaggctgtgtatatatacgactctttgacagtgacccacgtcactacacacaggcttgacttgaataacgagactgtcaaggcggttgttattcacggagaagtgccttacgttctggctgagtcagcatctgcctccagagtcattacccctgcgaagagctttcctctccattccgactgcattgcctttgccaagagccacaaggctcctttgcttcagcttctcgacggatacgtctatcttctacaagacactcttgaacctctcgccaaactccctcgatgtagcactatcgcttacactgacgagatctacggactgaccagcaagggtaagctctataagggcgatcaggtggaggcaagtcacgtgacttctctgctttcttccgacgataccttactatatacgacagctgagcggctctatctcgcgggtgagtcgagagagattgaaaagtcgtccctgctggtgtctgtgcatccttccacttactctgttgttctacaggctcctcgcggcaaccttgagactatccatcctcgtccacttgtgctgaaacgagtttctgaggctcttaagaatcgagactttaaggctgctctgaccatctgtcgaacccaccgagttgacctcaacttcctgcatgatcatgattctgagctgttcatgactcacgtcagcgagtttgttgaccaggtatcttccaatcatctggatctgttcctcaccgaagttggagtcaagaacaaccccaagggcaacgagatctgtgacgctgttctcactaacactaagaacctgctaaaccagatcaccgcacacagcttcaaaaaccccccagatgtggccgctgccctggccctggttgactcggaagaatcactggaacatctgtgtttcttgcatgatgtcaaccacctctacgatacttctctgggactctacgatctggagaagactctacttgtcgcacagcagagtcagaaggatcctaaggaataccttccttttcttcagaagctgcaggttatgtccgaggaccgtcgaaagttcactattgacgatcatctcgagaagtatgccaaggctcttgagagtcttatcgcagacaaggccgagcacgaagaaatcgacacctacattacccgacatgttctgtacaatgaggctctgaagctatacactgacaagagcgatactcagcgggtgctcaatatttacgcagcgtttttggagtccactcgagagtacaaggaggctggtattatctacgaatctctcgagaagtgggaggaggctctggaagcatacaaggctggtgtctactgggaagaggctttgtgcctatgccatgctgttgaagggttcgaagaccgagtccgagacgttgcagatgagctggctcctcagcttgtttccgcccattgctacaaggaggcctctaccctttatgcggactaccttggtgacattatggaggctgttagatgcctgtgtctgggctccaactttgttgccgcccgtgctcttgctgctcgaaaggctggtggtgaaaagcagagaatctttcgggagattgacagtctcctcagcgatgcgtttggtactcactcagagtttctggctgactgtcagacccaggtaaagaaccaggtgtcccgacttcacgaggttcgacagcttgctcaggtcagcatgtctcgagaactcgagcgcttggaagatgataacatggttcccgacgatatatctctggctgacactgcttctacctctggaaccttcctgaccaaatacactggtaagactgccggtactgccaagaccggcgtgtctcgacgaacagccaagaacaagcgacgaatggaccgaaagaaggccaagggtaagaagggtactgtgttcgaggaggagtatctggttgccagtctgggacgcctggtggagcggttagagcagtctaaggtggagatttacaacgtgatccaggctctgtattctcgtgaccgaagacctttggcccatcaattgcagcagtcgctcgtcgcgctcgctgcaagcttgaccgaaaacgtccagtttgtgttcaaccgaaccatggaggatcggaagcgaatcgacgacgatggcgctgtctactatctggatgaggttcctgttcccgaaattaaaaaggtggaggtttttgcttctctctaaaacttttgaagatacgtaagaatagagtgaacagtatttcaatgaatatggtataatacagtagttactgaaatgtcaatcaccacatactgtactgcatacagaagacagttctcttaaaacttgtacaatggaaacaaaagctttccgctgcagtgtacatactgaacaatacaagtaaacgggtaaatatctttaaagaatgtattagtcaataaataatcatcacactgtgttaatatcacattatggtcaagagtgctgttggaatacaaagcactctgtggtttcaaactgtccctcacaagataagagagtaaacttggacggtggaactcctctaatagccaagttaagatctgtcttgccgaaatacaaggggaatgtaaatatagcatgtctcccattggcactctgatgggaatcggcctcttgtgagtcgtaaatctgaacaatggtgtcgtgctcagtttcgaccaatagcttggcgtatccaatacgtcgcttcttgcattttcggatctcgtcgtcaattctgtcaagctgattcaaagtgaataccttggtgggagatgaggggttggacatctcttggttgggaacgagtcgtgtctctgaaatcatgaagatggagcaggtagcgtttttagactctctagtcgccagaagacgttgggcgtgagcccaggcctcgagagtgacctttttggttccacctccgcgtacagaagggtcattgagagagttgatgctgtggtcccagcctggccattcaggagaggcaagacccagagcgatgtactcagtattgttgcttgctccataggtggagttttcgtcgggaccacaaccgacaagaagcagagacaaacggtcaagatgtgacatacatgccaagatccctcggatggtcttctgaagcatcttgatttgagtatcgttacaagacccgataggaacgacaactaccagatctatgggggcatctaccggcgtggccagcttgattggcgaagacaatggaggcgtggcctcacatctccgtttatggaaagagtcgccgtggcgattgcctcggaagaggtggacgagggtgttgaaccattcatcttggtttccaggaatgtttactctcaattcaggagagttgacggagtgcacgaaaatggacatgtccttgccattgatcacactcgcaatgtgttttgaaatcacaagagaacccttgatgacggatcccgggaaaagagtcttggaggggtgccgcacaggataagagttctccacaaacaggacaaggtcatcaaacaggaatccaaccaacgacttgtaggttgtgccttggtccgtagagacctccattagatcgacacatcggatggaaccagcagtattggggtcaagttttccccaatcagcaactgatgccacaagattatccagcacagggtcatgtctctcgggaccatctctgggagagacctgttcatggtagtgaatgaaagagtcacgaccaccatcgtactcgtcaggagtgacgtcaatcttgaggttcatgtaagagaacccagggggcttgggagtgccgcgctgcttgttcacctgtacactgacgattggtctgacagtcgaacaggctactgctggagtcttctccttcgccagaggccacaacaaaatatctacccctcctgccgcctttcctggagacgacttgatgagttgattgattacatcttctcgttcaagctgacgagcctttcgaagtctttcatggtagagatcgttccattgtgaatcgtcaattggcttagatttttcaccacagacaggacagagaggtacgaggtccttgtcgtctggtgagaccacgtcatcgctgaggaactccatgtagcactgttcgtgagcaatgtgtttgcactcgagcacaagctttcgctcgccagctagaatgaaatgcagtggctcttcacagatggcgcagctgtcgttctctacgaaacggaccttgccagagaatacaaagggcttgatggcaggtggcggtgcgctgttgaaaggctcgaagctgttcttggttggcgtcttctttttgggagggttggagtaaggtggggatgtgtagcaggtggatgtcgagttgggtggagacatgacagagtcagtgtaaccatggccaggagattgtgagtatgaggtatggaaaatttgatcctggggagtctggattttagtatcgtcagtcttactagggcgtctcttcatgaatgtgagattgagagagttccgtagtcggctccgagttgatgtaggactcaatggacttgttaggctgccattggaaccgttgtgaaaagaagtcaagctctggttgctggggaatcgatggagatggtgagccgacgacatttgtgggattggtaacggtttggctgtcacggtgtcgggcatggggtgattggtgagtttggagatattcaggggcttaacggattcgatagtcgtcatggccgaagaagtgtgggtatttattgaggctggggtatgctggaagagagagaaggagggacctccctaggtatatattaattctgatgattgaataggcctttttcgacaggttaattgacttttgcctcatcgtagagcacaagagcatttctgaaaagtcacgttgttccttgttcctttgtcttttgggtatcattctggggtatacaggtgaagaacaacatgcttctgcctcatcactaacccctctatcggcgatgcaagattgggttgcatgatatggaaaggtacgcccattaaacaaagaacaacgaccacttgtacccagactttcttccccagatgtctgcagtatctcgataattaaagatctgtggctgaatatttcttccctgaaggggctgtgtattgtattgtccaccaacagtaaaaccgggtattgcattaatacttgttttcagctgtaatgtagctacatagagggcaacacttgcttagctatagcatctgagataggtcaagcacgttattaggcgaaaagaaccctgtcttcgacatgtcacttgatcttgttagattactggacgtatcagaaaacagctgacatctgtgctttcgaggctcggtggcgaagggtctggtgatcccagctttgtttctagctcaagtccagcgatctggtgtagttttagttggaattcctgaaccctgaaggaggggttctcgctttcacactgtctacttgaactatcattcggtgaggcaaagggtccaacttacttgtactgtatgtactgtacttgtcttgctcgtatctgggattaggaatgaaggcttgcccctggaaacatgtgctacttgacgcgtggactgaagtatgtcagcgcttcgggtagcgagtaagatttcatcgtcccgactaatgcttgtactccaatattgtaattcttcatcaggtatgatacatcatttttcactatcggttcgcttgatacaacaaggggggcgcctacctactgtacagttcccatgcccccgtctgtacgatactctcagctatcgtctctacagtatcggagccccaccacaacaaacaccatgcatccgtacagttacgcggggtattggaagtaccacaagaaaggattgatcccgtgtaatatgttataatcttctatcttaggtagatgtccatccgtctagccattctctgtataaaatgaattcacatctgacaacaattctcagatgagactgattttcacagctcgtatccctgtagatcctgacactttaatatccatctgctatcttggcttgggtgtagagtcaggtgacctttttttgtggtcgcgaatactttcctcgctaaaggatcccagggagctcttgaagtttttcccaggctaaagttttctctctcttcctaccagtacatttcgtacataccaatagcgagctgttgaatgcattctttgagctactgtagcgaaaaatctgacgtcgtcggagttagacaggagggtttagaactggatgaaaccgtttccaccggagactactggtacgaacatggcgaatggggtagagacagatgctctgatggacagacaaccaatattatcccaaaacagtatcgatatacgaaaagattttccagactacttgccacaaatgcagcgagctgcacattgatgcgttcatgcaagctacaagtacgagtaatttgacgtattgggcacttcaaggcagtctttcgaaatggccaatctgggagctcgctcaccctccgagataactgttgggcacaccagcaggtctcagcaacggttgaaaatgggctctcagttcaactaatgatccaagaaaatacaagtacgatgttgtgattggtcggactacttgtagacgacactagccaaagcgaaaaggcacccaccctatctgaatgctgagctgtgttcagccccaactcggaatgctgaactgttgtaagtcgatagccgatagatatatatcgtagcaaacacaagttgttgactcaaacgcattgacaaggaagtacagatccgagaaattgtgccgtgtcaactgctcccaggcacggtctcaattggggctatatctctgtatagagtaagccaggttggccccccacccacgagaaatgcaccaaccagtcggcgagctcaacagccgtatgggagcctctcgtttgatgtatgtgtgacaggaggtgtatattggggctactgggtgaaaataaaaacgcgagagagaatataggggtttcagcgaaatcccagtggagagaccgaatcatagtattataactatgacagtatcgtgcgctctcctctttcatcacttctctccaatatgcgtaccatctatcaccactctcttgcttagcctccctccctccctctctctctgttagacccccacacgctcaacagtactcaatatccgcgcagaaaaataaggttggtgggacatttctccggtgtgagcgattagtgggttgtggtggtgcccatagcagacctaaaattgactctcctcacttgacaacacacagatagaacctgcaacttcatccaagtggcgcttttctcaatccagtccgtgtgaaaacaagacaattgaccatgctcactgccgctcgacgatctacacggctcaccagccgactcggccaccaggtccgagcatactccatcgctgacgatgccgacaaggtgagtatttttttcgcccattgcgttggggtgtcgtggatttgggttacagggagtttttccgaaacatacgcctcacgaaacacgacgaaacggacgacacagacatgccatcgacgcgggacccctcggaattgattctacggatgccattacccctggcggtggcgtctcgttgacgctgctgagattgttaatgagaaacgggcctagagaaaatcgaacctctaggaacgcatgcacccggaaaaattattcctcacccaccagcaatccatcacaaaacgtggcaaaacagcttcaatcgaccgtatactaaccccagaaatgcacaatcacgctcaaggaggattcttacaccacctacatgcttgattctccccctcctctcgagttcgagatgaccaagggtgagcttctgcaaatgtacaaggacatggtgaccgtccgacgactcgagatggctgctgatgccctctacaaggccaagaagatccgaggtttctgccatctgtctactggtcaggaggctgttgccgtcggtatcgagaaggccatcgaccacgacgattctgtcatcaccgcctaccgatgccacggtttcgcctacatgcgaggtgcctctgtccgagcaatcatcgccgagctgctcggaaagcgaaccggtgtctcctacggtaagggtggatccatgcacatgttcaccgagggtttctacggaggaaacggtattgtcggagcccaggtccccgtcggagctggtctcgccttcgcccacaagtacctcgagcagaccggaaaggccacctttgccctgtacggtgacggtgcttccaaccagggtcagatcttcgaggcctacaacatggccaagctctgggacctcccctgcatctttgcatgcgagaacaacaagtacggaatgggtaccgctgctgctcgatcctctgccctgacgcagtactacaagcgaggtcagtacattcccggtctcaaggttaacggaatggacattctgtccgtctaccagggagccaagttcgccaaggagtggaccacacacggcaagggtcccctcgtcatggagttcgagacctaccgatacggtggtcactccatgtccgatcccggaaccacctaccgaacccgagaggagatccagtacatgcgatcccacaacgatcctatttctggtctcaaggcccacatcctggagcttaatttcgccactgaggacgagcttaagtctgtggacaaggctgctcgagctatggttgacaaggaggttgcccttgctgagtccgaccctgctcctgaggctactgccaaggttctgtttgaggatatctacgttcccggcaccgagcctcctgtgatccgaggccgaatcccttccgaggactactactttaagaactaagtagagtagaatgtaattactaatgtacgagccgtcgttttctgagaatgagtagaaagcaggagtacagtacatagattgggtgagcttgaagtgattgtggaaaatgttgcgagagaaacatggtgaatagtaagtgagaaagaatttatcccatttattttatcattttttgcccttttaaaggcacgcactcgggctagtacaagcatctgtcgtagaatctgcagtagctatattctacttgtaaattgaccctgctgcactgtgggctcaccacccaattttaacatctgttacgcatatggttcagaaaataagcacatctacgctgaaataaatccttcacgcaacacacacgacaccaagcacatcatgtcgaacaacaatgacatgtctcgttacaaatagtgagtattagaggggatggtgtgatatgactcggctttgtgtgacaaacgccattctggatcacttactaactacagcgaggagatgtcctctattgtggtgcaggccgatagaaggcacatcaacagagagagtggcgaagacaaggctattcccgagtctttagtgggaaagatcaacgttaaggatatgggatctggtgtgcgacgggaggttccggatgctggggttcgtcaacagcaggaaaagatggcacgcaaggaacgaatgacttccaagcctacttcggtctactcttccagcggtttgtacactccacaaatgcctcaaactcgtgaagcgtttgagctgctcatggcatggacggggcgtgttcttggggatgtatcacacgagactatctgtgctgttacggacgagttgatcgctactctacgagacgagaagctgcaggacaagcagcggcaaaaggagatagagagcattgttggaaaactatccaacacggacttcaaccaggccatgagtttggctgctcgtcttactgactatgctgagaatcaggacgaggagatggctgacgatggagagagcggagtggctgtggttttcgacggaagcgacgacgaggacgccatggacctttccgaagatgatgaggatttgagtgatatggacggcgattacgttcgacgtgtgcctgttgctcagagggagggcgaggatgaggaagatatggacgtggagcagactgttgtggaggctgccaaggagtccgattcagacgtaatccctgctacagaaatcgactcgttctggctacaacgtgaaattgcatccctagtcggtggtgatcaacaggagagtattgatctatctcgtcgggtgtttgatattcttgccggggagtcttctctgcgtgagactgagaacgaactgtctgaggcctttgatttcgaccatctcgactttgtcgccaagctgtgtcataacagagaccgcgttgtttggattacacgacttcagcgagccgatggacctgagaaggacactgtgaagaagcagatgacgtctttgggactggcatctctcgtctctgagctacacggtgaaacggagacttcggaagatgtggatatggacgtcacagaagatgcttctcagacttacgttcccagatacattgatacacagtcacttgtgtttgatcagggtgctagactcctgacatcttcgaaggtcaagctcccagcaaacactacaaaacacagcaccagtcagtacgaagagtttgtcattcctgctcctgaaagagctatccctgatgctaatgagaaggtggtatcaatcgctgatatgccttcttggacacatgttggcttttctgataccaagtctctcaatcgaattcagagcaaggtgttcccctgtgcattcgaatctgacgacaacatgcttatttgtgcacccaccggtgctggtaagaccaatgttgcattcctggccatgctgcggtgcctgtctcatttcagagctcccaatggaggctttagaaccaatgacttcaagatggtgtacattgccccgctcaaggctctggtccaggagcaggtccgagagttcagcaagcgactcaactccatgggattgaaagtgtccgagttgactggtgatcataatctgactaagcagcagattgcagagactcagctgctggtgaccacgccggaaaaatgggatgtcatcacccgaaaggctgccgattccagctacaccaacctcgtcagactgattgttattgatgagattcatttgctgcatgatgagcgaggacctgtccttgaaagcattgttgcgcgaacaacacgtcggtcagagcagactggagaccctgttcgaatcgttggtctctctgccacgcttcccaacttcaaggatgtcgcatcgtttcttcgagttggtgagacaggtcttttctactttgattccacttttagaccttgtcctctgggacagcggttccttggtatcaccgagaagaaagctttcaagcgatacacagccatgaacgacgcatgcttcgacaaagtgattgaaaacatcaaggctggacaccaggtgattgtctttgtgcactcccgaaaggagaccgccaagacagctcgaatgctgcgagatcgtgccatggacgagggcctgctgcctcttttttgtgcctctgatggcagtcgtcgaactcttgcagagcgtgcccaagatcctgaactcgatgccacacagaaagagatcatcggaactggtctcgctacccatcatgctggtcttgcacaggttgaccgtaaggctgcggaggagctctttgctgagggacatgtccgtgttttggtgtctactgccactctggcttggggtgtcaatcttcccgcacataccgtcatcatcaagggtactcaaatttacaatcctgccaagggtcaatggaccgagctgtctcctcaggacgttctccagatgcttggtcgtgctggtcgacctcgatacgacgactctggtgaaggtatcatcattactacccacggggaactcaactactatctgtcgctgatgaaccaacaactccctattgagtctcagcttatgtcacggctggaggattctcttaacgcagaggttgtcggtggcacagtttcttcggtgggtgatggtattcagtggctaggttatacttacctctacgtccgaatgcttgtttctcctggtatataccttgttggatctaatcccgatgatgccgctcttactaaccgacgtgccgacctcgttcattcggctctcagcaacctggccaagtctggtctcgtcatctacgacaccaagactggccgtgtgcgtgccaacgatctaggtagagtggctgcacattactacatcactcactcgtctatgcgaacataccgaatttctctcaagccccatttctccattgtggagctgttccaggtgttctccgcctctgaggagttcaaatatgtgggagttcgccaagaagagaagctagagttgggaaagttgctggaatcggcacccatccctgttcgagagtccgttgaggactccactgccaagatcaacgttcttcttcaggctttcatttcccgactgagtctcgagggctttgcactggtatccgatatgatatacgtgacccaaagtgcccagcgtctgttccgagccatctatgagttctgtctgagaaagaaatgggctcgactagcccgaattacccttgacgtgtgcaagatggttgagcagcgtctgtggctatcctcttgtcctctccgtcagtttcctgactgccctgctgaggttgccaagaaaattgaggcttctgctatgccttggaagcggtacttatcgctggagaatgcagaacaggttggagaagctatccgaactcctcgatatggcactcctgtgttccgaatgcttcagaagttcccccagctcaagctgtctgctcgcgcactgcccgttactgcctctctcgtgcgactggagattgaggtggagcccagttttgagtgggacgtttctattcaccatggttccgagccttttgctctgactgtggaagacggagacggtgagaagattctttactcggactcgtggaccctacggcgagattacgccactgagactcacttaattgaggtgtctgtcactgttgctgacccccgacctcctcatctatttgtgactctgtcttccgagagatggttgcacgccgacgctcgtctggctgtgcctttgcgaaacattgtcttcccaggaaagttcccagcccctactcagcttattgatctgcagcctgtccctgttgttgagctaaagcgagccgattgcgccgggctctacgacttttctttcttcaacaagatccaatcgcagctgttcagacctcttgtggagggcgacggctccgtctttgttggagctcctcctgggtctggtaagactgttctcgccgagctggctctactgagactgtggaatgaagatgctgatgccaagactgtgtacttggctcccacacaagcccaagttgatgctcgctacgatgattggagtcagcgaatgaacgagattcatggaggaaagaccttctcaaagctgtctggtgagcttgctgctgacttacggaagctggccacctccgatgtggttttggccactcctaaccagtgggattctttgtctcgacggtggcagaagcgagctgctgtcagagctgtaagcctgttcattgccgacgacgtgcatctggttggcggcgatggtacctacgagactgtcgtttctcgaatgagatatatcgatgtacagttgcaggagagtggtgctggacgacctcttagaattgtcggactgggtgttcctgttgccgatggagtagatatggctggatggcttgacgccactccctacaacttcaaaccttggactgcttctcctaccaatatccacattcagtcgttgtccatccctcatcacccttctctcatgcaggctttccttcgacctacatacaatgccattcttgagcttgctccccccaagcactcccagactgtgatctttgtggactctcgtcgaactcttgtggatgtgaccattggtctttccacgattgcggacgagcaagttctggtgcctcctgttcctgaggactccaatttggagcttgctatggcacaggtgactgacaacactctcaaggaggccattcagagcggtattggccacctctaccccagcatgtcttccagagaccgtaagattgtgttggcactgtatgctgagcagtccatctccacaatcattgctacccgtgaggaatgttggacctcgcctcgttctcaactgagtgtcattcttggtacccagacctacgagggatctgagcaccgatacgtcaactaccccatctctacggtcttgcagatgattggacaggcttccaacgacgccctggtgctgactcccgctgctgccaaggactactacctgcggttcctcaacgattctcttcctgtggaatccaacttgggagcatccctacatgatgctcttttggcagagatctgtgagaaagtgatagagtccatggatgacactgtggcctggttaacctacacgtacctgtaccgacgcctgcatgccaatcctggtttctacggtgtccctgaccgatcagatgatgctctcaacgtctatctttctgagctcgctgagactactgtagaacagcttgttgaggcaaagatggtcgagatggacgacgagggtggattggagcctctcaatgctgcatccattgcatcctactacaacgtgtctttcgatactatggctactctcacatctgccctctctcccaagagtaagtatagatctatcttgcaggctgtcaccactgcagctgagtttgactctcttcccatccgaaaccacgaggacattctgttgagacgtctttatggccacatcccctggaagcttcccgagctggactctgctgttcttctcactcctgctttcaaggcctttgtgctggctcaatgtcatattgctcggctgaatctcccttcggagttgactgctgatcaggccgaggttgtccagctgctgcctaccctgctggctgcctctgttgatcttctggcttctgagggccatcaatcatgcatgtacgcaatggacctgtcccaaatggttgttcaagctactcttgagtctgattcgcctctgcgacaggtgccttttttcactcccgaaatcatcgacgatctcaggggggcgggggttgaggcagtcggagacatttccgagctggacgaggacaagctcaagggcattctcaactttactgcgaagcaactcaagcgtgtcattgactttgtggacgcctacccaagtattcagctcagctatgagcttgctgactcttacgctactaacgatgtcggaaccatcgaggtcactgtggagagagatgtgtacgaggaggatgagcgtgctaatctggaggtggttgctcccctgttcccccagcccaagacggagaactggtggatcgtggttggaaataccaagacaaagcagatttttggtatcaagcgagtcaccttgcctctcgagtcccagactttcaacatcgatgtctcgttccccgagcatggagaggtcagtggtcacgtttggtgcatttgcgactcgtatgttgatgcggatgccgagaagaagttcacagtgactgtggctgagggtgaggaagcggaagaggttgaaatggaggagtaagaggatgatcataaattatgtatattattattgtattgtataaccttgcattgactgtgcctgtggactgctcttgtgttttaattaaataatgcttgttatattatatgctgctacggatatctgtacgtaccgttgttatcgagcagcaatttcttttttggcttgttcgacttctctgagaccctcttcaagatccttttcatcgatatccatggcatcctcgggggcaagtcggtaacctccatcctttttggatccctggtactcctgaagctgctccaatgaccacactgaaacaccctcctggtcttccttgttcataggctgggccatagttcgcaaaaacttcttggctgcagctagagccatatctgtggacagatttgtgtcagcatccaaaatggcctggttgatccatttgggcagctggtttcgcttcttggcaaaacgtctgtcagccaacaccatgacaccgtagtcatctttacctcgcaagactcgtcccagacactgggcagcatggcgcatggcatcgaaagacaagaagtcgttctctcgaatgtggtagttatctcgcaaaaactcgagacgagccttcaagatacgcgactcggtgtactgaaaaggaacaccaatcataagcacagttcttccaaactggtggtcgaaatcgataccttccgaaacctttcctcgagcgacacagagcatgacagcgcctcgaccgttggagcaggcagttcggtaagtttctaaggcaagagaggtttcctgagcatcaggagtctcgaccagaatgagtttgtacttccacacttcgtccagaatacccatagtctgccacatggaaatgatagactccatgtaaagatatgaagggaagaagacgacaaggccatcaggtgtgatcttagaaaattcaatcagaaggttaccgtagtttcggacaactgaaggatcgtttcggatctcgaatcgagaactgatggctacctggtctgaacccttggtcacaatgagaggacagaaggctcgccgtgccagtgtcatggtgtacgactcctgaaccacagtctcgaagttcaacattttcgggtacatatctagaggggagatggtaccggatgtgatgatgatgcttgagaaccgatcaaagacaggcttgatagcaatggaggcgtccaaacatgtaagatgcaaaatggggttaggaacggtggcctgatcggtctcaaagggctccagaatgagctggaagccggtgtcgtaggtagacaccaaggtggcgaacacagcaatctccttgagagcagtgtaatcatcgacgtgagtcaactcgagggttctgaccaggtacgatagacgctcagcgcagaatcgaagaggctttcgttcaatgtatgtcaaatctcgaagatgtttcaagaacgatgcaggggtttcggaaatgacatgaagcaccttcattcgactcttgagatattcaatgaatcgtttcaagaaggccacgaaatgttctgcctttcgaatgtttccaggcacagcttccgaaataagatcttcagggagcacagggttagcgagaaacgtatcttcttgttctccggattccagatctcgcaatccatccaccagtttgttgtattcatttttcaatttctcagagtcgctggatcgggcctcactgaccttcttggccagatggtttgctccccgagtggctcgtttcagggagtcttcagtaatgtcgacagacagagcctcaatgcagacgttgtcgatattatgggcctcatcaaaaatgacaatgcagtctttgctcagctccttggaaactcggtcggcgatcttgggatcgagtagataatgataagagtagatgatgacgttgcagaaggccatcattcgacgcacagtaaaataaggacatgtcttgtgctcctcgccatacgccaaaatgtcctcaaaggtgaaaacaccaggtggaatgtagttgtgaggctcaatgtcgttcatgttctcgtggtattcacatagagtaacgtcttctcctgcagccagcttctgcttggcaattccagatgtcatggctcggcacttctcgtcgacaatgtaacctttcttttcgtatcgcacattgggattcagacacaggttctttcgtgaggtcagacccagccctctaaagtcctcctcaaagcctagagtctcagttcgaaacttcatgaggttcttcaactcagccagagccttctcgatctccgacattgttcgggaacaataaatgatctttcgatgctcgggatagtgttgctggtacgccactgtcagagacaacagggagacagtcttgcctgttcctgaaggcatttccaagatgcagttgcctcccacgtccagggttttcttgatgtcgcacatgtaggcatactgctcgggatagatccgagggtatggccacaacaccggcagatcatcgatgtagaacttcatctctggtggttgatctgtcgcaacgaatggtgctactgatatatcaaggttgtgtaatgcatggcgtcgtggttagggtagattgttttgggaggagctggggatctgaaaaatttatcaggagtgtgtaaacggctcataacccaataatggtatcattaatagtaatcatgtccgtaagctgtctatctgtctactttttaattctgatcttgtgtgcatgtattcctggatgctcataacctctgaaccctaataagttttttcaagcgctgtagctaaatttttttttcatcctgcagtctcacacatcacactacaacaatgggcaaagacaagggagatatcaccgttgagattgacgaggtcgacaactacgacgctcgaatggaggctctgctgcccttcgccaagcctcttgcccccaagaagctcaacaagaaggtgctcaagaccgtgaagaaggcttccaaggccaagcacgttaagcgaggtgtcaaggaggttgtcaaggctctccgaaagggcgagaagggtcttgtcatcatcgctggagacatttctcccatggatgtcgtctctcacattcccgttctctgtgaggacaacggtgttccttacctcttcatcccctccaaggaggatctcggagctgccggtgctactaagcgacccacttccaccgtcatgattgttcccggcggaggcaagagtaaaaaggccgacaccaaggtcgagtacaaggagaactttgacgagattgtcaaggacgtcaagaagctcgaggattagttatttataatgtacactagcatgagaaaggaaggaagagggtgtcaactaatcttgacagtagggtccgatggttaggatagtcggactaaattatgtatagaatgttacctattcgatttgttgctcgtagtgggattgtccgagtgcagcaatacctccttcaatgtcagacgctacagtatgtacaagtaccggtactgtagatacttcatacactattaaggactgtacttgtgcttttttctgtattgtagttggatccacgagtggagggcgttgctgctgtaatatatcttctcgtttcttcatcaataattatctagatactctaggggcatggtctcattacttcgtcatcgggccttgtcgtcttagtagtgtcaccttagtggtggtggtccaaccactcgagaaagtcgggggtaaagtaagagataaggaggttggctccggctcgcaggttaccgtaggccgcctcgaaggccatcacctccagatcaacaacgcccttctcggcagctgcgtggatcatggcgtactctccggaaacctggtaggtagcaataggcacgtccttgcagatctcagcagcgtccaccacgatatccaggtaaaaggtggaaggcttgacaatgacggcatcggcaccttcggccaggtctcgagcaagagctcgtcgagcgagacctcgaccgccagcggggagctggtatcgctttcggtctccgtggctgggagcagagcaggcagcctctcggaaaggtccgtacaggtttccggagaacttagtgtagctcataaccatgacgttgtgggcaagaccggccttgagcaagccctttttgatgtcgtggattcgaccgtcaatcatgtccgagggtgccacacagtcagctcctgccttggcgtaattgacagccacggcagccaaacgtcgcacagttgtgtctcggataacagttccgtcctctcgaagaacgccgcagtgaccgtgcgaggtgtactcgcacaggcaaacgtcacacatgacaaacaggtcagggaaggccttcttgagagccttggtggcctgaataacgggtccctcgggatcatccgcagcagttccctcaagatccttaacaccctccttcataggaacaccgaaaagaatgacagatcggaggcccttcttgaccagagagtcgacgtagggcaccagcttgttgacgccccatcgcttctggccgggaagagagctgataggagtctcctcctcgggatcatcagtgacgaaaagaggatagatgaacatatccttggtgaggcggttcttctgctgccactgtcgagacagagggtgggcgtaaccgccgctcagaatggaggagatctgggtctcgtgttcttcaaggtactcggctttgtggaccatggtggtgtgataatgtgatgagtgtgaaatttcatgcacgtacacacttgagtttgcgttgtgggggagtttgggacggacagctcattaagccagcagagaaatagcgttgctcttgtagtaagagggtgttacagaagcaaggcaatgaggtagctggcgtagaccaagatccttaccaccttcctggtatcgctatacgacctcatttcccgattggcattactgacgcttttcctagtcgttaactaaacagtagcctaaaacttcaagtaatctcttccaggttgaataactcaaaattcctcctcttgcgcacggcccacaagaagggtctagaacttcggatgcctagcaattaatgttgagctagtcatggagcctgtttcagaccctcgcagtagaatatcgccactaaatatatccgggaaaaaaaacgcaacccaatatgaagcatctaccactaccaacattctacactacgcagtatcggcctcaggcacacccttcatctcaccggtgctcataacctcagataacgataccgaatcttataccaaaatatccaaagttagtgcggaccaagtgcatatcataaacagcctaaactccagctttcaaacagaaccatatggactgccattctgaacacgttgaacacgatcacggtgaccacggccacgaccatggacacgaccacagtcacgttccccagccccatacctcttcggctcagactctgtataatcggatttcgcacgctggcatccgaaccctgaacgagtctgaagagggagccggagcctctgtcttcaaggactgggagtcccgtctggacacctccaagtacctggagagtgacgtggacgagcagcttcttatccacgtgccattcacgggtctgtgcaagatccactcgctgctcattcgaaccaccaacgacgactctgcccctcgacacatgaagctattcaagaacagagatgacctcgacttttccaccgcctccgatctcactgccaaccatgtgatcgagcatcccgagggggtcggaggcactctggatcactccattgaggtcgcccctacgtcgtcgtctctggatgaagagggtattgctgaatatgcactttcgcgggcccagtggtccaacatcacgagtctgacgctgtttgtggaggacaactacggcgaggacgtgacccgaattctttacattggtctacgtggcgaattcaaggaacttaaccgagcccccgtcgtgacgctgtacgagtcagccgccaaccccgcggatcacaagaagattgtgcctggcgaggagtatgttggagacacgctttaatcagccaattccaagaacctttagtacgtatcacctgtatttatttaaaccaaagtgttgtatatatgaagccaataaatattgatgtttttttatgttcttgaccagtccgccctgtgtgctttgtttaacttgcgtatatccttattctcacaccgtttgaattgcgatgctgtataatgcggatgagccggtcatgtggggagatgagccagccacaacatcgaataagggcagattgtgcgaagcattattcagacactctcgcgcagacccctataagcactcatacaagtacgagtagctatatacttgccctatatttctctatcgtacaagtacttgttctcgttctggagtagctatatataagttaatcctatttacactacaagtaccatgtgcgatcttgcagttaaaacctgtgcgagagggaaggtctcgataataaataatagacaatgagacccatggaaaaattagcgagtagcttgcctaaccaagaaaaaataacccatcatccagcctgaattatcttgggcacactggctcacgtcagcctcatgaccctcttgaaacgcgacagtcgagaggttgctgcaggcggcagttctgcaagaggtatctgcgtctgcgaggacaatgaggggctatcatctgaccctgaggtcgtcgtggtggtggctgtagctgtactagtgaccctagtatctacagttggtgtggggacctgcccattgctagccagccagtcaggcatgggagggggtgggggaatgtaatattgtgtcttgcacagcggacaagacgcatttcgattagtcatccagggagtgatgcaagagaagtgaaacacgtggttgcacttaagaacacggatctcatcacagtcctctagctgctcgatgcaaatcgcacacgtatcgggatctgaaggtggctccactctgtcggttctagagtttgtttccgtgagcgataacgcagatgcacctgcagagttagataacgacaaaaatcccacattaccgatatcctcctccacgacgatggtagtgtggtttgcggagtcttcaatagcgtcatcgctgaaagcctccatttccttttctgtcatgtttctttctgcgacttctttctccagtaccttttcgtccacgctcttttcgttggtgtatgtaccgtttttccagtcggcgtagcgtgtcatagggaagttgtcgtccatgaatgccagcgacaccaccttcttttgtcgcttccttcgctgcctggctctgggatggcctcctgtcatcaccataccgcgggcaatcatgggaatcatgggatcgggagattggttctcaggatccgacacagctcgttgtcgctggcgtcgtcgatataggaaccggatgcccagaatgatccagagattgacaaagacaattccaagagcgagggcaatgaagaacagatagttctgtgtagtagaagtgttgcgttgttgctgagagtttgggtttgtggggacaccagaaggaggcccactttgagttgatgtgggtcctagagtggccgttagtgaggtgactaaagtgttgaaggtcgtaggcgtagccggtgtatttgtgggtgtccctgtcaagattgtgatcgacgcggtggtagacattttaggccaggtagatgcagagacctatatgctgtcgggtgatatgtagatgttgtgcgtgtggaggtttaagaaggccctttctgcaaacagaaacaaatggatggaggttctttgtctgtgtactgtaagctgtctgtacttgaaccggcacttcgatgtgtcagtaaaacaattcagagggcgaacggatgtgcacgaaacgagcggctgtgtccacaacaggaaacctttgggcgaaagaggttccagaagaatggcagatgcaggaaaaatacacctggggacttttagagtaccagtctagaggcgatcggctcgtttttatcgtaaaaaagcggttgcatgcttttatatcaacacccaccaccttgcataatccgccaagatttgcacattaactcacatgaccctcagcctcactgtcatgaacccaagtataaagaagcttatccacgaggctcgtatccacagctcaaggtcattctagagatgtttgtgggcgtcccagacgccggccctcggctcctcgtcccattaggcaaccccagcatggactatatttcggtaccttactttgtctgtcgcccgtacacctgcctctttgtcgctactctctttatttcgccaagaattaattagtctagcaatttgtgttttttagccttcccatgtctcttacttggcacccgggggtagatcttaattagtcaccgaggaccaaagacgcgaattatcaacccttacacatcatggcagtgtctagtcactctgcgattttcgcactatcaaaaacttatagtaaccctggctaaccgcagaaccataccaagacacgccaatgcccagcacgtatagactgtcaatgatggttgccgccgtactcagaaagccagccacactatacaaagagttatttgcttcgtagggctacatttcctttttttatatcctctcttcgtctttgccacactgattgtaaaagtcgatatcacatcacccactttttagtctcacgcacgttgcacacgttattgctatcggcgttccaccccactgaagcagcctaaaaactgagactgacagggagcgtctttaacgcacccctcctagcgctacaccgtggcggagtaattataaaacatgtcacaatatacatttcatacttagtgagaaccggctcctcgagaaactcgctcgagaacagattcgtaagcaacctcggagaagtcagtaccctggatctcggtggagataccggtaagagcccgtcggagagagtccttggaagaggcgtagatcatcttgcttcggacaggagcggtatcgggagaccaggtgaagaagacaagcttggatcgcttaccctcaccgctggagatctcgtactcaaagtcgtagacggcgtatcggcagtcgttctcgggcagcttgccgaggaaggtgtcgtaagagtcggtggttccctcctcctcgacaacaatctcggtcttggcatcgttgatcttgtaaatgatgaaggtgaccttcttgccgagcttgagctcgttgaaagcctggagggcagagtcgttaacggcaacaccggatcgggactgagttagctatgtatgacaacgttgtgttccatcacatatataaatctccacttgctctgaatattccccttccatatcgacctgcttcatcgcatgctacaacggcgagcatgttttccatcaccccattgttctcgtgcttcaaaagttaaagggcaatactggggcctttgtggcagaagccgcatatcgagagggtcatatgccgaaccaacaagaatcagacgaaagaaggtacaataggcgcgaggcggcaaagacgtggctggatggtcatacgcttgggtatcaccgtgacagccgatgagacatacgacacaccattgtgcttttcgagcaacatggttgaaacatcaatcttgtaaacgcagacaaagtgacatcaccagaagggggtcatcattcttgcagttgccatgtagtttggtggtgtcatgtctttctcggatcgttcaaattgtcgatgctcgtcttatcacacccccatgatgccatgagtcccgaaccccaaaccccaagcgccattaaattccaagtcgtcgatgtcgtcgttatgacacaaggatcattctgtagactccaaccagatctctcaagtgcccaattcgcccaattgcattgcccgcaggtcgaaatccgggttgactccacgttgtttactcaccatttttaatgaataggttgtgtgtagctgagaacttgggtgaggtgttgccagctgtacgttgcgggagcttatacttccgggtaagttggtgcggtcacgtgcataaaaggggcacactgaccaactataaatagtggtgatgttaaaacagcggtgagacgtcacgatccgcactaaaaaagtggagtaatttaaccctgcaactgtggttttattgtcaattcttctagtgcttaactgacaaattaaatttctatatacatatatgcattgataatgtggagagctggcattttcagactgtcacgcattcaccatattaccagatatagcccatctacagctacagatcagatgtttttttcccccctccgaactccctcgtgactattagcagtaatcataaccttgtgattactgtagcccctcttaattggtgaggaaggcagcgtttcggtagaaactggtcatggggttctcaccggtcttggtagtggttgcatcaaggtcggcccattgttccaagaactcctgatgggtagaaatctcaggcactctgccacacacgtgacgaagaagctgcgcagcaagctcaaagtcggtggggaagagaatatcgaagtaaccctgcagaaccatatgtgtgttagtggtgaccatctggttgtcaagcactgtctgaaccacaggagagttgtatccggagaaccgtgaagtggtggtctcgggcagatgtgtgaaatcagaagacagcaatctagcctgggggaagtacttcttgagaatatacaggaactcgaggtatcgagtggggatgaactcggggtcagacagttcagagtggaagggccacatgaggtttcgggcctctttgtaaagccaaggggtagacagaggatggaaaccgagtctgctatcgggagagtagtcctcaagagcctccgttcggatctgaaggaaaagcttggtccattcgtcgagcttctgagtatacacctcgtggaagtctccattggcatcaaccagaacatgaccctggtagggctgcaaagttcggttatcgtatcggacgatatcgtgggcaaagttgtcaaaaacttcgagggcgacaaagaagcaggggtcgttgacgggctccttccaatcaaaaatcgacttgttgatgatctcgaccttggaccgatgaccggtctcggacgccttggtgtgcagagcactctgctgcttgtgagccagctggtcggaaatctcaatgaccttgtatcgggttcgctcgtatacctcgggctgagtatctcgaatatagtcgagaatgttggtcatgagcgtaccgttacctcctcccatttcgtagatgatcagatccttgtaggggtatagcgagagcttgtagttgaccagcaagtatcgtgccagagcctctccgtagtaaggcttgaacagctcggtgggggtatgccacagctgtttcgaggcgcccctcgatgtgaagtccttgtcctgagcgggaaaggtacccgaatggctcgtatcttttgtcttacccgtcaaagtcgggctgttagctgcgtatttggagtactctccggtccacgtgttgaggaagtcgtccacatcattgatattcgtgtaatcgaacggtttgtcggtggtgaaaatctccacgttccgggagaagtagccgtagtaggggttgtaaagagagtcgtccatgaagtccttggcggtcattcggactcctctgggccgtgaggagctcttggacagcttcttggatgtcatcagagggtacttgctgaacgactccgcattgtcctccattcggtacacgtaagtcgtgggtcgcaccgagtagtcatgcacaaagggctgtttcttgccggtcttgccagaatcaggtgctgccgagggctcacccttggggttcggcagcgactttttggaggacgttcgggcgaagatcgagtagcttcgcgtagcgggcatccgcattcggcccaggcgggagggcaatcggttcattgtcgttgctgctgggctgtttggccgggttcacctgcagtacaaattatcacctttatgccggtgtacactaacgataaatagacgttgggtgatttgttcatgcagcagacatgtcgaaaaaagactgaaaccgaagcactgtaaatactgtaattgcataaccagatatagcatccaaatccagcttaaccggcaaccgtctacaccatgagtttaccgaaagttcgtgagtacaagaacaacaagtgacagacatacccaccatgacactaatacagacattctgggagcaggttcaatcggatctctgctggcgtacaacctggccaaggctcaagtcgtcgcccccgtgttgatgctgagagatgcagctcgacagatggacttcaagaagcgaggctcgtcagtctacttttgcggcaatgacacgcctctgtcgcagtttggtattcgccacaattacaacaccgagccattgctgactggggaaggcattaaaatcgagaccatgactccagaccagatcaaggagccactgagtcatattatcgtcacaacaaaggcccagagcacactcagcgcattattcaactacagggacgctatcgactgcaacactgctatgttgtttctgcaaaacggaatgggactgaaggaacaaatggacgccaaggtatggctgaatgaggacgataaacctcacatattctttggagtcactacacacggagcgcacagattgccgtcgccattctacgagtacagacacgccggccagggtcagattgacatggctgtggctcctggaaccttgttggaggagaatcccttcgaggagattctgcagtcctcacctactctgggatgccaggatactatgccatatcccgaattgctgctgaaacagagccagaagttggttgttaatgcgtgtgttaaccctctcactgccctcatggactgcaacaatggccagttgctggatagctacgcgactagcaccatcatcaatacagtggtgtttgagtccagcatcattctccgagaatatttgcttgataccattggacatcagattaaccctgctttgatttcttctgcgctcaagccccagagactgaatgagctcatcaacaaggtgttacagctgactcacgataactcatcctcgatgagagaagatgtgcggaacaatcgagtcacagagatcagatacatcaacaagtttcttatggatatgggtaacaagtacaagaaacccatcaccgccaacctcatgctatacaacctggtgaacgcacagcaggacttcaacaagttttaacagtctaatttgtatatatagatattgcatggaataaaaagaatgctacggtacatgataactcgttaaacacatcatttattattttttttaatcgttacatcataaggtcatttctgcttctggtttagatcatcactgtttagatctttttctcttcttcagcaccgaaggaggcctcctcggaggaagtggttcctgcaagggcttcgatgtcttcagaatcatggtggacgcccatgccatcgtccatagactcggattccgagtctcccttgatgtgaggcatagcattctcaccgtcggtgttgttctgggcatcatccatcaggctgacattgacgtcaggaagagtcagggttccaacgaagatgaaggaagccacaataataggcgggtatagcattcgtcggtagacgtcattaaaggccgtaacaatcatcattcgctctggtgtctgccatttgtatttgagagcagctccaatgttgtttgcaaccagatggttctgagcaggggttaggaagggggcgaaaatggccagctgtttggggtaggattgtcggtacatagagccggcaatagcttccccgataatggttccaaccgtcatgatggacaggtagatggctgtggaagaaaccacattcttatgggacaccacagactggagcatgacaagcatgggcatctgcatcatgcccgatcctacaccctccacacactgggcaacgataaactggccaagatgatggtgaggttgtcggtagtggtatgtcagaccgagaccaagcaggtagatggctgcaccagcacaaacaactggcttgaccttgtttgtgagctttgtgtaggcagctcccacaaaggaggagacagtggaagcgacaacaaaacatacagaagtgttggtggcagcagtgacggacaagttcttacacaccataagccagggcatgtaataggttccgtaaaggaagtatgcaatagagtagcaacagatgaggaagcagcaggtgaacatggttctgttcttgatgatgtagaagggcatgaaggggtacttgggaaccatttcccagaatgggaaaaccaccaagagaataggtccaatgacaatcatggcaagaatgtgtgcctgggaccaggacttgggacccgtagcaagtgtgacggctaagaacaaaagagtcagacctccagtgaagagaatcaaaccgatgaagtcaaactgtcgcatggtctctttgaagtttcgcaccgactttccgtattcgagacccagccttcgggccttgaacttcagccgtagcatgataccacagacaggaatggccacaactggcataacaatgcaccacattccgtaaccccatctccaagtggaatgcttggtgatggcgtttgtaataggagcagcgatccatggggcgaagagatacgcaaagttgggaagcgaaacgaagaacattcggttcttaaggcttgaagtgtctgccgcgaacacttgctccatgaactggatgcctacttggcccgagacgtagaagatatgagcggcaaaatatgttccaatgttctgacaggctgctaacatgataaacccaactgtgaagaacaccacagaaataacaagagcctcaaatcgacctagaacatctgcaagtttggcgacagtgggtcgcgaggcggtgtacatgacagacttgacaactgccagtgctgaaagaagagaaagctcgttgaaatgtgaagtagcgaaggtcgagtagacgttaacagtctgagattcaagagcaatgcaaacagaaactaacaggagtgaacaccatgcaaagaccaactccgtcttggagaagattttgttcaggtgctccatctccttgacaccgtcagtgacgttggtgtcgtcttcgtcgtgggctctctccacctgagggttgaatacgacttgtaggtagtgcttgaagctctgcattgaatagccggtatgtcgaaaggaatagtttctgtagcactagcatgcaccacagggcgacgaggtctttatctaccttgattccaaccctgatctaatcaatctcatcgtcttttttttttcacgctaagcttcgacatagggggttaaccgtcatgtgcactttttgttttcgactaggaacctgtcggcttttcattttctctcggcttttcatttcccacgatctccaggtatacccggttttctcaccaaataaatttacatttccactaggcttgtgggtttttctcatcagtgtcctgcagcgttgatgcgtccttatatgcgtaggttctaatatcaggggctagcgaaagccaaacttggtcggcgcgccggtgagcaaggcaaaacaggaatttaccacacgccaagaccaggaggttggaggaacatcaacaagattcctggtgacataaagttgaaatctaccagagttgagagcaaatcaggaccgcgtgtgcctacatagagaaatcctccaggcaaatgtgcacagcaagctcgtcactcacctcggttgttcagtcgacacctttggcggacacagccttcactgttgggtcgcgtgccgagatcatcgcgtccctttcttccccccacacgtcaacaatggaaatttaacgctgagaaacttttgagacgaaagagaaactacaggcttaattttgtattctgagcaaaagaaacgggcgacacaatgctcattgaaccttgcctttggtaggaaacgctgctcgatcatactgcgtaagtgcaacaatgaaaaatacatgtatcatatgttcattaggctacttccggctggttacggagcgccgtggctttgaggtgaagatctaagtagccccgacaattgatgttaagtccgccagtagcgactggataatcttcaaccgactctgatgcaaaatttccacacaggatcgtagtttggcagaagacgcaagaatagcctctgtctcctgggctgaagtagtaagaatatccctcaagcctgccttcatggtgttctggaaacgctgtgtgcctagttttccatccacaaagagctttagcagtcgtgcattagcgggttcggctgactggagaaagtggatagctgcaaatgcaacctgggtacggaacgatatagaatctggcaacagggtgtactcgccgtaatagcccatctccctgagaacagtctcatgctgtttggtcaagaaggtgttctccaatgcatcgctgatatcgacatcatcccatgggttttcaggaacggtgaaaccgtactcgcacaaaagcactgagtttgatcggggtccgtagcataagaagatttcttcgtccgccgtatatcctctctggccgcaaagaatctcaaagccaatggagctagtcttgagttggcagtgggtgggtcctgactctaccgagtgattgattagatcaacatacggagccaatgtaatgttatcaggcacttcctgcgcgtcttttttacccgtagtcaacgtaagatcaaagtatagacaacgagagttcacacagagccatgcccagagataggcgtctctcggatccgagtcgtacttggccacaaacgtcttggtcttgtcgtagtctgcctcgaacgtgtccagtgtctttttcaacaccacaatgccctccggagtcagcgagtcctgatcctccttggaccattgcaatggcacatccaggaagccttcttttctgtctggcaacagccccatgaaagccttccagtcacttttggaccctaagctctgctggatcacaaggaatagagctaacacctgatgggccgacatgctacggtactctgtttctgacaggtggccgccgtctaccattgcgttatggatcgaagagtaattgagcagctggcgaagctttaggtgaatcagacgctcattggggtatacacgatcatttaccacaagacctcttcctcggccagggagttctcggatttccaacttgggcgagatatatccaccgttggaggtgatccactctattaactgcacgtggctgttttccatcgggttaatatgtgtgtgtctttggtaatgtgatatcacgatgttataaacaagtatctgtagttcagtacaaccgcttgtttgttgtctgcattatctgcgagaaatatttcccacatgctctatccaataagcttcctgaatgaacccaatccaacaatgggggttttatgctgatgcgagtagacgtgacatagacacccagtggtatgatcttgtgcagggatctgattatatcgaggagacctccgaatgcctatcatttatggcctcccactgaagctaggttggctaactagaatgattgtggccttaccaccagagagctctaagtaacgtgctcatctacaatatgataccggtacgactacgcaccgatctgattacagtaggcttcgcacaagcctacttgtaccggttctgtactcgtactatgaagggctacagcgaagagctagcatctcctacttgtagtatcgtacgcacatgacgtacatgccatactcacggtaaaggcaaaagcaaaagccattcgctaagcgagatgtgtccgagaataaaccatggacctgagctccacgttttcggctatgctgtaggtgatatggtttacttttgtgctttctgcgtctgactgttggcgcctcgcatttatcggatttcagttctgtcaggaagtactgtaacggccaccctaaactgcttagacctggcccaccaccaattctcgtgccctttagcttcaacaacgcccttcgtatgcttgcacgatgagagtccttctgcaggtatatgagatggcattgtggttggagaaaagtgaaaggggaaacaattacaagaaccaacaggcaaaagctgctggtccccgacaaacactctgaccctctctccatggcacaaacttacacctatcaatgggagcctgcaactttagatttgtgttttgccggttacaggccatctgagtgagtaacgtgcaacacgctctctttccagcccaaaaagttatactccgcagcttaacccaaactcccggaagcttgcgaatctacggatgaatttggagtcttgtggggccgtcataatggttgtttggagtgtgttttgtatcgatatgatggggttttcatgaagataacgaaaagagcccctccagacaagtataacatgccgttgagcttgttcaaaaccgtccctgattctcaactctaactgagcttgaaggctgagcttggatatgcttggatatgtgggaagctgctgcatttcgacaacctgctcatactcgaaccaagagggctgatcgtatcggagtcaatactcgcatatgtgagagagagacaaatgagagaaaaagcagcttgagcgagcccagattagggttccacggtcttacctgagcgccagctctacttgtaccgtaccagcatagctcgtcattggacatacaaggagaactcggattcatagaccgtaggttgggttgcgcaagcacaaactcacgtgaggctccagtttaggacgggggctcgtatcttacatcaaggcatgaagaagaaaatattccacttcaagcttcggtttgagctggattttccctggagatttcgttcctcatttccccgagcacattctcacccccaccctctcaggggatattcaaccttggcaccagtctaaaccgtgagcttgtaattaagacgactgtcaggcactcacagggtcctgagtgccctgagatctgcaggttgagactgctcataaccactaggggactcaatagatgggatgaccaatccattgaaggcgaaacagggtccttcccgcagtgcgatccttgctctacatgtgcaaccgtttaagaccgttgaacccttgttttcggcgattaaatccgagcttaggttctattgccgagcagcaccacacagactcagcatatacttaaaagaactgggacaagcccacctactgtaagctcgcaacctgtggaaaatcactaatttcgaaaaccacacaaatcgaatcttttcgacaccagaaatgcaactaaattaatctccctgtctcagctcatcttcaacacacacaatggaccgtccaaatgtaccatcaccaccagcaccctggtcccaacatcagagtttatcttcagcaatctagcctctaccgctagcaacaatgtcgcggccattgaatgtgagaacagaccccatgaagagacttcgtttgtgaatctctcgccttccaatccccactctttactaacacagaatgaagatgtgagttatcgacactgcgcctgaggcaaggccacttgcagccgctctacgtaagatcataccgagcaactatactaacagacagtcattgctgactgccaccttggcaggcgttactgcaggacttgtccagtcctctctaacttgtgagtatgagatgagttgatatcgtgaacacctccgatgagcaccccactaactagaccccttcgagttcatgaagacgtcgctccagctgcgacgaaaccttcctggagcagcagcatgggtccccccggactttggaaaggtttacttcactggtctgtccgccgtggccattggagccgctaccaaggctgttgtccgagtctctaccttcacggccttctccaagttcatggccgacgaagacaacagaaccactgctccccgagtggtcactgcaggtctgctcacgggtattaccgagagtttcattgtggttcctttcgaatccattaagactacaatgatcaaccgagtccaggttgccgcaggcaaacctgttgctgtgcctcctactgagataaagcttccggagaaacctgagactgctgccaagggacctgttgagactgctcccgtcactatcaaggacaagaaacgtgttgctcgacctacgggaaccatcaagcctcccaccgtccactatggccagattgatacctcagtctccggactcctgggcaacatcaaggagatgtataaggaccgaggcattcgagcctttgtccagggtttctttcccactgtcacccgacaggccgcaaactccgccgttcgattcaccacatactcggccctcaagcactggcttactaaccccgaagacagcgaatacggccgtctcagcgccgtatggggctttggtctcggcctgctgtcttctggagccatggtcctcgccacacagccaattgatgtcgtcaagacccgtctacagtccatccacggtatcaaggagtatcgatcgtcattgcagtgtgcctacaagatttttgtggaggagggagttatgacattctgggccggtactctgcctcggttctgcaaggccggtcttagtggtgccatcattttcggaacctacgagagtgtcagcaacgtccttaacgctgcctctcagaagaagcctttcccccctggagaggaatagactgttagatagtgtaaatacaattgattatagcatggaatgcagatattggttcagatcgtgacatgacattattatatataatttgtttaggcggcaataccgagctccttgaggaaagcatcattgttgggctctcgtccaagaacctccttgagaccctcaatctcgtcccgagatccacctcggtcaagaatagcctttctgtagtcaagaccactcttggtgctcatggggtcgtccttgaaccgagtgtagtagatgtcggcagcaaagacttcagaccacaggtaaccgtagtaaccagagtcataaccgcccataatatggccgaaagtagagtagcctgccatggactcaccatcgttcttgaccagagcaatttcctctcgcatgtcgttccaggtcttgtccagatcggcaggagtatccttgatacccttgttgtgaagaccaaagtcgaacatggcaaaatggacctgtcgcaggtagtgcaggccgtcacagacgtgcttggtggcaaccagagatttgattgtctcgtcagacatcttggagccgtccttgtagtgagcggaaaagtgcttgatctgctcaggctcccaggtccagaactcgagcatctgagaaggacactcgacaaagtcccatgagactgaggtaccgtggaatcgagacagtttggtggtgcccatgagatcgtggataccgtggccaagctcgtggaagaaggtagtcacctcggagtgcttgagaagagagggcttctcagcggtgggtttggtgaagttgcagaccagagaggtggcgggataggttcgagaaccatccttcaggtcggtgaaaccgggaccaatgccaaaattggcagcatggccgtacttgttgggtcgagggtgcagatcaagatagaaccatccgacgaagacaggctcagcagtgtcgtacttccacacagcgtactgcttgacatcctcatgccaggtggaggcctggtccttgggtgtctcgacgaacttgagagagaataggttctcaaagaaggccagagatttgtcgagaacattctgcagagggaagtattcggcaatcttctcctggtcgatcttgaattggtcctccagaagcttgttgaggtagtatcgggtctcccacacataaaggacgtccttgtagtcggcagacttgccctgggcttcgtagtcagccttcttgataggcagcagctcagcaatgtccttctctccctggggcttgattcgctccttgaggtcctccaggaaaggcatgacgttctcgtacttcttggccattcggtcctcaagcacatagtcacagtggtgtcggtacccgagcaggtttgctagtttggttcggatttcgacggtctccttgagaagaggagtgttgaggtccttgactcggttctggtcgccaaggaaggctttctttcggacttcagggttcttagcggatcgcagcacgggaaacaaatcggggtactggaaagtcatcttcagcttgccgtcctcggtcttctcaaagccgtcggtaacgtccttggggactccctcaagctcctcagcagtgaatgctaggaaggacgtgtcgttagacaggttgttggagaacttgatggcaagctctccctttcgcttgttgagagcctcgacctcctttcgggtctcttcgggcagacccagaccggatcgcacatagcccttgtacatcttctcaatagctcggatgtactcggggtcgagggtcttcttgagctcgtcaagctgcttgtggacagcctcaactcgctggaagacgtcgtgtcgcatagtggactcgacagaggcgtccatgagaatcttctcagcctcggcagaggcctctcggagttccttgtcggcagaaacatgctggaagaaggtcagctggtttcggggcagagctgtggtgttttcgagctccagctggggcacaattgtgttctcataggtggcctcctcgatggggatggctccaatctggtcatccagcttcttgaaagaagcagccatgtcattggcggatttcttaacctcctcgggagtgtacttccagttggggggctgctggggaggtgtggacattttcacggcggcgatgacagaggcgaggtcaggaggagtgctggtagttgcaagagttcgggaagcaaacttggggactcgcgacgtggtggtggtggtgggacgagtacaattgacctttgcgggggcttgaacggacactctagtggttatatacctgtgtagagttggtgcggttcgaggtggcaaatgcggggagtgtcgcaagataagattcacgcgagtgccgtgtcttagcatggtgtgtaaatttgggaggacgggtcaagtgtgtttggcagaagatctgtggcgtgcggcttgtgggcggcgtttgagagcaagccggcgtagtgtgtatatacaagagggaggctcggtgtcggtgggaatggacttttagttgctctgaaagtcgctgagactggaaaagatcaagactgcgacaacgaactgtccacagttgggagctgggatttgtcgttgcaatttttgagtctgatttggttaggctttgtccaccacagcattaatcaccagcgccgtggataaacagagagccgtgcatgactggagacatcgataggcagtgtttggaagcctcgggatgagtgaggtgctcgggttagtttgggtcgtaggtggcgtcggactccggttttgatgctgatttgaaagattatgttagtgtttctaacgggtaagggttatggacgtggtcaaaagtgtgaaaatgtgtctgagtcatcagagaccctgttcgtgacggtacagtatgtactgtagtagggactatctcagcagtctatagccacttatcgacagatatataactgtaactacagtagagaaccacccgcacattaaggaagacaatcggcccatctcatctggcacggcactcgctatatgttcacatgtacttcattcatgtggatacatggcacctgcattaccactgataataatcaatgaccagatataccagacattcatgatccagtgatatcacttgctgaacgacaccctcgtcgtctggttattgctcgttcctaccacatgtgtctcaatgatttactgcatcgttcagggcgttctgttcgaatgatccagtccatcaactcagtctcatcaaatacacaatatattaaaaacgtcatggcagagctctgcacttacaaacacggttctgcacctcttttagctcgtcgaactggtagagcttagtaccagttctcggtgttgataagaacagtcttctcgtcaacatcgttgtcaggaacaatctctccaatctggtacaccttctcgccaaccttctcgagcagctgggtcacctcagcaaccttctcctgcttgacaaccagaatcatgccgatacccatgttgagggtcttggagatgtcctccttgggcacattaccagcctttccgagccactggaacacgggaggaagaggccaggtggaaacgtcaatcttggcggaatagttttcaggcaggattcgaggaatgttctcgaccagacctccaccggtaatatgggccaaagcagaagtcagcttggcgttaatgacgggcagaagctgcttgacgtagattcgagtgggggtcagaagagcctcgccgagcgacttggactggtcccaagggcaggcgtcagtgtatgtgagaccggcatgctcaatgatctttcgaaccagagagaaaccgttggagtggacaccggaggaggcgagaccgagaatggcgtctcccttggcaatctcgtccattcgagggagaacggcgtctcgctcaacagcaccgatggaggttccgttagcgtcgtagtcgttgccgtagtagatgccaggcatctcggctgtctctccaccaatgagagcacagccagcctggatacagccgtcagcaacaccaccaacaaaggcagcagcggcgttgacatcgagctttccggtagcgtagtagtcgaggaagaccagaggctcggctccctggacaaccagatcgttgacgttcatggcaacaagatcgataccaacagtgtcatgcttgtcgatggactgggcaatcttgagcttggttccaacaccgtcggtggctccaaccagtagagggtctcggaatccagcagccttgagatcaaagagacctccgaagccgccaatgacggaatcggttccgggtcgagcggtggacttgaccttctccttaatttgctgaacgagcttgttaccgttgtcgatggagacgcccgcctgagcataggtgattcctccagaggtcttctcagcgtctcggaaggccttgtaagcaatgtcctttcggttgtacttgccgttaaactcaacagcgtcggctcccttgtaggcctgggcaacagcgtccttcagagtgggagcaacagcggtagatgcaatgactcgaccgccggcagtgatgacctggccattctcggaggcggttccagcgtggaaaatgtaagtctgctcggggagaccaccgacagtgatagcgtcgcccttcttgtagctctcggggtatccgccggcagacatgacgacggtgacggcgtgcgcatcaggcttgactcgcagagtgacggcatcaagtcgtcgctcaacacaggcaagcatgacttcggccagatcggtatcgtccgaaagcagaggcagaatggtctgggtctcagggtcaccgaaccggacattgtattcgagcaccttaggctttccgtcgggagtcagcatgattccagtgaagagcataccgacaaaggggataccgtctcgtcgcataccgtcaatggtgggctggagaatggactccttgatctcctggagaagagcaggggtaccgatgggagcagggcagtaagcacccattccgccggtgttaagtccctggtcgccatcgccaattcgcttgtggtcctgggcggggggcatgtcaacgacagtgtaaccgtcggagaaagccagaatggagagctcgtctccctcgaggaactcctcgatgacaacctcgtcaccagcctcgccaaaggccttgtcctgcataacctccttgacggcggcaatggcctcctcggtggaggtgggaatgagcacgcccttgcctgcagccagaccagaagccttgattacgactcggtggcccaccttcttgacgtagtccacggccttgttgtagtcagtgaagttctcaaacgcggcggtggggatgttgtgcttcttcatgaagtccttggagaaagtcttggagccctccatgacggcagccttctcagaagggccaaagacggggataccaacctttcggaagtgggtctcaattccctcgaccagaggctgttcgggaccgggaatgacgagaccaacatccttggactgggcaaactcgacgagcttggcgaagtccttctgggaagagccaatcgcaatgttctcgatctttccctgggggttgtcggttcctccgtttccgggggcaacaaagattcgctccaccagaggagactgagccagcttccatgcaagggcgtgctctcggccaccgttgccaaccagcagaattcgaaggctcatgattgtgtgtgggtgatgtgggggggtgttgtgggtgggtggtgaacactggacgttagtagaaagagctttcagcacgtcgataccattttcgaattaaaaatattttttaagcttcacactttgcaacagacacccgttgtcagtaactcgggtccataggcaccaatggccatgggcatgtacgtacacatactcggtgtgtttttacccagattcgacgccctacattgtagaccaattaatgcaagtccctgcccggacctatccctacatcgtacctcatcccccctaatgcccgcaacagcaccagtaggcattctccactactaattctgcatagctctgcagtgtccccagacagtaaaaatgcttcactcacgaatgatggccaataagtcatacccaatcccaaaagcttagtagtcaaatttttggcacagagcagccacccattttgatctgacacaagactaccctacttgtagcatcctggtaagcggcttacaccaaagatacaaaaccaatctacactctacagagcgaccgtgactcacgtattggctgcacctgcaatagatctcgcgcacacggtctactcgggtcccatgcttctcgcagtggcccaggatacatttcatgcatttctggagatagacttttacagtagccgtaccagagccatgatcttacttatacatgttcgggtacccacggcattcgactgaaccacacttgtagctacagtacaacgtttcatcagtcaccaactagaatatcatattgctatataccccagagacgaaaaaaaggtcaaaaaaaagggttggaaaaatatggcggaaagtgggaaagataacccacaaaaaccgtacacaaaaaaccaaaggaagattgtaatcgcttttttcaggctcgcgttcttactgcgacggctgctggggctggccattgttgaagccctgtggcggctgaggagggaagccctgctgctggtaaccatagggagtagggggcatgtagccgccggctccctgaggaggcattccttgaggaggcattccctgagggaagccctgaggaggagggtagccgtatccggggccgggaatgccctgaggaggaccctggggaggtacgggacccagagagtgctggttttgaccgtcctgttgctgctgctggttctggttctgctggggctggaattgctcgtttcgcttactctccttgcctcgaggcatatcagcaatggggaagggtcgggggatgttctcgctggactcggcaacgtagaggttcttgtcgatctgggcagggatgggcttgatctcagttccaagttcctgctcaatcttgtacaggttgtatcggtcgttccagttaatgaggttgatggcaataccgagatggccaaatcgtccagatcgaccaattcgatggagataggtctcggcgttcttagggaagtcaaagttgatgaccacgttgacggcctggatatcgatacctcgggtaagcaaatcggaacagacgaggtttcggcacgtgccgtttcggaactcatggaagactcggtttcgatggctctggatcatcttggcgtgggagtagtaacatgagtatcccagctcagtgatctttcgggcaagtagctcaactcgcacagtggagttgcagaaaatgatggactggttgatgtcgagcttagaaaagagcgtgttgagacaatgcagcttctgtttctcgtcgacaaaggcgtagtactgcgtgatacctcttagggtcagctcgtccatcaggttgatttcgtaaggcttgtgcaggtttcggtccataaaggccttgacagtcagagggaaggtggcggagaagagcaggatctgacggtcctcagggaagaaatggagcacctgctcgatgatgggtgtgaagtccggcgacagcaacttgtcggcctcgtccataataaacatgggcgactcgctgagatcagcgacgccctttcctgctagatccagcactcggccgggagtgccgaccaacacgtgtaccgtgtcttccagacgcataatgtcgtctctgaggttggtgccaccggtggtgaccatgaccttgatgccaagatgcttgcctagggtcttgcaaacctgtgaggtctggagtgccagctctcgggtgggcaccatgataagcgcctggatcttgttaactttggggttgacctgctggagggctgggatcacaaacgcggcggtcttgccggttccgttcttggctcgggccagaatatctcggcctgcgagggcaatggggatcgcctcttcctgaatgggcgaggggttttcgaatcctgcttcaaagatgcccatgagcagctctcgtttgaggaaaaagtcctcgaaccctgtaccctttgtggcggtcacatcttcggttttgtgacgcgtgtcctttttgggcacgtttaacgactctttccactcagacatgtttttgtgtaaaatgtggggtggtgcggtgtcgtggtgcgtgtcgtgggcaaacgggaagtatggatatccggaaactcagaagtagggacctgcgatggaacagtgtaggtgtcaattgtcgattagaaaactccagatatgtttgtgttctggtgttctgtgatggatggcaataaaacagttggctgtattggaggtaggggagaaagaagagattgtcggctggttgtgggtgtattgaaaactttactggggtgtggattcattgggaagggtaagttggagtgtccgtgaccgtgaggaggaggactccaggccaccttgacatggagaatgtggtgttggtttgctacgtagttatataaagaggtcctttttttgttatctctcttttccacgtttgtcattttgctggctccctctgtttttttgctgtcgtaacccttttctgtctctatcctcacctgcacacctattacagctcgccacttacccggttgacgaactttgtctgggcacgacggtggcttggagaggagcagagcagagaatgagtgaagatatcacttgtagtgtaaacgagtgaaatgacgaagatgggacgatcatccgctggttttcccccatacacgcgcttcacctcaacctgtaatggggcacatattatgactgtctcgtccaacgtctgaacagtcagatgtatgtaatattgctcccacacacgcagcccattttccccttcagcaaaacagatatacttccattaaattatccacgcgaacctcatcgaaggtatagaaaggtgtacttgtacggtacgagcatgtgtgctgaacagatacttgtagtcgcagatactgtcggtacagtggtcacagatgctgtctcttcatcagctagcagagagaagtacatcgcgatacttgtacgcgctagaaatcaccattttgtcacccatctaagctaaaagtacaagtgtgattactttagtatcactgatccacatcgacaacagaacgctgatacctcccaccaaacacatcgaaacactgcttccagtgttccaagtctcataccaaaccataacgacggcccatttggactctctcgtccggttcaggcagtgcagtgcagctcgaatgtgggccaaggtcacggcgtcaagagtacatactgtacgtgggtggtattacctcggaaattgccctcccattttcaatcaaggttagctccaagtataagtatcgtagtggcatgagctgagcgatggcagagtagctactggtgccggaacgatacagatgtgtgtggactcttgtgttcagagatcgtcgttgccccatttgtcccggccacctggcaacttgcacaaaataattaactccgatatatatatatatatcaagccacatgccccaacccccctacttgtagcttttgcacccacaccccatccatccacaaccacttccccattcggccaaggtctgcaccaagcgcatcgccaacgcgtagcgtctctcccaacgtacggtaaaaccacaaccttcaacctgccagacaatagaccgataaaaacggtacattgtccatcgtgtgaacatgtctgtcgacctcaaacccaagacgctgaagcgcaaaaacttcaagaagctgtcactcaacgccgacgccggagtggcgccccaggcaacagcttcccctccgccatcacagcccttcaccctcgacaaacccacgctccagagagcgccctcagcaggcaacctgataagccaaatggcatcgctggagctgggcgtggagttcaaaatcgacatccgggctcaggatctgcgcaccatacaggagctgggcgcaggcaacggcgggtccgtctcccgggtggaacacatccccactggtgccgtcatggccaagaaggtgatccatatcgaggcaaaggaggccgtgcgacgccagattttgcgggagctgcacattatgcacgagtgcgactcgccctacattgtctccttctacggcgccttcatcaacgagtcgtccggcgacgtggtcatgtgcatggagtttatggactgcggctcactggaccgcatctacaagaaggccggcccgctgaccgaagagattgtcggccatatcaccgtggccgtcgtcgagggcctaacgtatctatacaacgagcaccgcatcgtccacagagacgtcaagccgtccaacattctcgtcaactcccatggccagatcaagctgtgcgactttggagtgtctggcgagctcatcaactccatcgcagacacctttgttggcacctcaacgtacatgtcacccgaacgaatccagggaggaaactacactgtcaagtccgacgtgtggtcgcttggcatctcgctgctggagttgctgctgggaaagttcccctttgacatggctaacggagctgtgggacccatgggtattcttgatctgctgcagcgaatcgtcaacgaacctccgccaacccttccggcagaagacaccaggttctcgcccgtgtgcagacggtttgtcgaccggtgtctgtataaggaggccgagcgtccttcccctcagcagctcatcaacgatgcctttatcatcacgtctcgggccaagcaggttgacatgaaggcctgggccatgagcgtgcagtagaagggtgaagagaagactctgaggagaggagagaagcatgttgtttggtgcatagagtggacgtttccaaaataaatcatatagtaagcattgtcattgatgttgttttgtaagtggaatggtgaggagatggtagctcgggaggtggtggtggagagaaagcgactttttttggaaagtctacaagtcattaccgaaatgtaggtctccagactacaagcatgtctgatgtccgctggccgtgtcgatcagtctcggcgacaggcatatagtggaggtagataagagcttaatggggtgttttggtggagatgatgggattagtgggcagtggggccagaacaagagaagaggttggtatcgtagtgacgtaaagctgatcggcgggaaactactgtgttgtgtgtgttatactaatgggaataatccggcggcgagaatagtgctttgctggcagttatcgtgaacaggaatgtacagtgtcttagcggtgtctcaggcgcttacgaagattgaataatggtcgtaacgtagtgtctgagatgaaagtgggcggtctgcgtagctactgtatgttgagatcgctcgtgagttgcagtgggtgacagttagcttcgataatttccaagttactggtggcaacttgtacgatacttatattaaattgtaccatgtacttgtactgtagctacaagagcgtcaatcagacgtcctcagtcgcttggacaaccacaagtcaaagcttttacagcattattcgaagagtagatacaacaccagatcgatatcatacagtcacatacaatgccagcaccagtatgtagacgcatccccgcacttgattcttttggtagacctcgggtcggcaggtcttcacagtcatagtcatctttcatcaataatattaatatgtacatggcatcagcctgagggagaggccctggaaagtatttgtaaacgcacttgtaaacgcacttgtagatcacagtacctaagcatgaggagccttaggagagaaaaagtaccaggcattgtagatgccaaaggctagcatggcaaagccgaggcctcgcacgccgccctgccaggcctgggtggcagcaggggggagacgttggccaggctgcactcggaagggcatgttggatgcaaagtaggcacctcctcctgtgagaacaacggtctggaggatctggcaatgggtgcactcattgggagtgaggtcccgcgattcgggtgggttgaataccttgagaatgttggagttgttggacatggtcagtgtgcttgttgtgtggtggtgacaagtctggtgatggtgcgccaagcgtcaaaactttgctgtggtagatcttggacttgctttaattatcatacttggtatgcggaaacttaatacttgggaatttggttgggaagagatgggattttttagagaataatattacacactctgtgcggtatacacaggcaacagtgcaaacagcatccagaccatgatcgtataatacggactcatccacccttcgccactcccacatgtatgcaactctgatgtgtcattagtgtcctgtcagacccttctaattaccgtacaatacaatgcttgtactcgtacgaacgtctgactggcgccaagacttgtctgcgctgtgcagtatccaggtaatatggacgttgtggggaagcgtttggaggagtggggttgaggtacatcaaaccccctttgacaggggactactgtaaccctgactggcgcaccttgcggcttttaacgcgtgagatcgcttatacctgcgagtttcttcttcgcccaggtctgggtggttctagcgaggtgtaacggacgcagttacaggtggtgctcgtatgtactatgcatgtcttcagatccatacaactagagcgttgcctgagctcaacctgaggggtggaatacagcacactggttacagtagtacaagtacacgtagctttaatctgcaacttcccagttgtacgacctttttttttttttgacatcgcaactcctacagactttggaagaggttgaggggcgggatccgagcccatcagtttttttccaacggctggctgcctttcaaccccgcaccatgaatacacagattcaagggtgtggacgacgtctatcagctgagtttttccgaatcgtaaaagatacccagcaactcctatgcgtcttaccccaggttacgaatgtacgactgtacgcacactggagtgtcgtcatttcaaatgagaacaaaagaaggacgaaaacgaatgtagaggtcctaatataagctcacaaaaaataatagaaatagaaaattataatgtggtatttatggtagctactgatgattaggcctacaagtagggcaatttgcacaaaataaggtgcattatacgtttcctgccagacactaacgttcgcactaatgtcgggttcccgagactacgggagctaaaaagaacaggatagactggtgtgagcgacgcaaaaaaaggtggaactaggcctcagccggcaattgagacccccaatgcgtgtatgcagctattattgctgttgtctcacatgtatttctattccctttgctcgagcccttgttcgctatgcatagtgcggctggcgagtgtggggagaggcgcattaccgcaaatagagtactaggaagagaaacagacaaaggccgaaaggcaagagagcgcatcaaaagatatcgtttaccaaatatgggctaactcgccaaaatgtaaatacacaggcgttctagcaacgtcttagaacaataggaacttgaatcagatcattaaagctgatctaaagggggtctattcttttacctgcagtattcgcaccgtgtatactctgcttcggcatatgcccggcaacctggactcccacctttattttcacccttaaccttggcgttcatgtaacagtcgccgccatgacaatcggggaggtaacaatttctcgtacaaggaccctcccacggataaggtcttacccccaccatatgtctgcttgtctgcttttgtggccacgtccgattaagcagcttcgtcccttgtctaagggccgtcaatgcatggatatcgaactcctccagacaaggaccagcttggcgatgaatgcatgactcttttggatctcttggagctacgggtatataactgggacggttaactggttagttttccatctccaagcatctcgatccccatcgactctcaacgctctcatacacatctccttacgcaacctcaacaccaacctgcatctcaacatctactcaacaaccctgcaacaaccactttaagaagacctacatttctcctatcttctctagaacccacaatggacgaaactaaggaactctccattgaacacaaggagctggctgagattgcctccattacatctcctaaaaacattggactccccactgccgaggaaaagtttccgaacatcaacagaaagaagctgctgcgaaagatggactggcacctcatgcccatgctcacaatgctttatctcatgtcatttctggaccgaggaaacattggaaatgcacgaattgagggtattgttgaggatctgggactctcaggtacccagttcaattggtccatcaccgtcttcttcttcacatactgtgtgtttgaagtgccctccaatatgcttctcaagcgattccgtccatccatctaccttcccaccatcatggttgcctggggcattgttatgactcttatgggcattgtcaaaaactacggtggtcttctggcttgccgactcattttgggagctactgaagctggtcttttccctggtgtcgcttactatctgaccatgtggtactgccgagctgacatgcagtaccgacaggccatgttcttctctgctgcaggatcagctggagccttctctggtatccttgcctttggaatcggaaagatgagaggaaaggctgacctcaacggatggcagtggatcttcattctcgaaggtatcgcaaccgttgtcgttgctatcattgcgtacttttgtctctatgacttccctgagactgccaagttcctgaccgaggaagagcgagagtacatccagtatgctctcgagtatgatggctacgatcgagacctcgctctcaagggtggagctcaaaactctgacgctgttggacgagacaactccaacaactccaagttcctcaaggctgccttcatggacccgcagtcttggattggtgcgcttcttatgattctcattgtttctcctctctactccatgtctttcttcagtcctatcattgtcaggagtatgggtcattccgccagtatttcgcagattctgtctgccccatttggagccattggagccatcaccactgtcattcaggcttacttttcagacaagtacaagaggcggttcccatttctcatggttaacttctcgcttggcatcattggatacgccctttgcatcaaatatggtgtcaataaacaatggatcacatacgcaggttgtatgattgtcaacatgggtctacagccttcattcatctgtcacatttcctggatgtctgttaatattgctggcccttacaagagagctattgccatggctattgttatcggtttcggaaacatgggaggagctattgcttccaatatgtaccgagcttccgacgcccctcacttcaaacagggtcataccattgccatctcctttgttgccgccgccatggcggtcaccatctgtctgtatcttgcctacaacttcatcaacaagcgaaaggccaagcgattgttggagggccactatgaccagtacacctccgaggagctatctgccatgggtgaccgatctccttacttcatctaccgaatgtgattcggacataatcaagtgtataataatatcgactataattttgacctattcccatactgtaggctgtgtggcagaagaaaagttttcgactgggctacttataagactgggctttcactcgtactattgaaaattcgaaatcgatttataaattacttggttgtgctacttgtagtaacatcactccttattgtcctctagtacgggtctcatagctaagaccccttttatcacgttagaccattccatccgtgccaaacacgagggacaatcgccaccaatcgggatgatgtgtcgggaaggtgtggtgaagggcaattcttcaggtatctcctcattcagaaagcgctcggctaattctgccacgtcaaaggccccatcacagttgtgacagagagcaacattgccttctgagatgttcagtgtcttctccgataaatagcaagtgagttgtttgtcatttgaaacagcatctctgcacttttgtagatattcttctatgcttctattgttgatgtcgagttccccgcttcccactgtcgatggtggggcttcggcttcgtccgaggggtagtctgtctcgacctgaaactgaggtggcagactgccaacatcgtaatcgttcttttcccacgcttcatgcgcatgtgagcggaagaatgtgattctcaaatgcattctgcgaaagtaggagcatctcactagcagacggatgaaggctagatgcgttcccaaagctctggctttctgaggcacttttcgcttgatgtctttagtggtaatgagacgagtcatgttaggatgttgcagggcatgctcgaatttgagagcagaaatcttggaagggaatccgttgacaatcagcaccatactccaaggtcttaagtgtgctcttttggttcgccatgctcctccggccttaaggtctccgttgtgctgccgaatacgtcggaacggattcggagtagagcccacgtagcaggagagaggtttctttgtagactgcagcaaatacactccgtagaatggagggtattggtgcgtcatggtatcttgtttttatggtgtggctattaagctcaccactttgagagatgtttgttgtgtgcagtgtgcagtcggttaatattgaaggttccatgcagcacctgagagtgacacgcacatggtacatacagtacagtacatccgatgttggacaatatttggaggtgggttacagtagcttatataatgtttcatacttgcacatcattacatgtcgaatctcaccctttgatatcaaggtagagtgacattatcgagtgaactgctatatctcgttgtccataacatcaaatttgggtggcgtttagttacgactcacgtgacgatatcacttgttctcacgcgactacccaccaacagttgacggttattcgcaagatggcttcattttgttgacagatatacatcacttgtaagagtaaaagcggtgtacctaatatagcctgccgtacttttacgcgcctcagtaggctaccttcccactcatattcacaataaaatgatctgttaatctatacctcgcctaaacgacaaaacaacatgtactagtgtacagccacctgtcgtgggcagtttcttttggacttttggacggtcttctaggtagcttagatatcatcgatatcaagctcatcctcctcatcatcatcatcatcgtcgttgtcgaactcgaagttgcactcgtcgtcctctccaccctggtcagcatcgttgatcttggcagactcaggaagctcaccctgagccttgagagctcgagcctcatcggggtggtacttcatgatgacatcagccttgtcgtcctcgaagtctcgcagagaaagcagaatgatatcggcctggttgatccacaccttctttcggagctttcctcgaatgtgagccaatcgcttgacaccgtcgaagcactgggcctcaagacgaccgtttccgagcatcttgacaacctgggcgtactcctggccttcctccttgtagacaagctctcgcttgctaccctcagactcgttctttcctcttcgtcggttctttccgccctagagttagtaaggtgggcatttcagattattccgttggcatttccacatgtgcaaaataccgcctagcctcgattctcgtgccgcaaaccaccgtcagctactcacctttcccttgttcttaggcattttgtagtatactatctaggaacaaattttgatagggttgaaaaactaagggagaggcatgtcccaatcgggaagtcatgtgagttacccggccggcagagaagagcaccgaagatacgactttggaagcagctatgtgtgaactctgtattaaaaaaatggaaattgtttttatggaggtccccgtgttgcttccaaattaataccatgtcaacaagtcaagccccgctaagctgctgttttggtttgatgttcagatgtcacacgagatggagcatccaaggcacacagttgggagtttaggctttcacacccagcattagttgatgcaagtcaactacagtaaattacataaattatattgtgtgccaacatcattaatcatcacccccacacagcactatggatccttttgaagctcgaatgacgatggtggagctcgtgggacggctcaacgcctcacattcgtccgaatctaccctcgctagtttcatgatgaaacacgacgacctcaaggaagacctctacgcctgtatcatggagattctcgagagcacagccaaagacaacgtcaacatgcgtaacaacatcatgtgggcgctgggctttttgtgtatgaagattgaagagtacgagagtaaacggaaacgcaagattgctgaaggcacgccagtcggagactccaaggacatgacgttctacaacgccagtctggtcaatgatctggtcaagatcaccacagagctcgtgtgctcagacgacgagattggccgaatcaacaagcagagcgcgttgctgtttctcaacaagatgaagaaacgcaaactgggaaccgcagctggtaagggtcctcagggcttggagcagatcgaccgagctattgacattctacaaaagcgacaaccaccagtacaggatgaaaccgacctcaaactgcccatgacaaatgcgcagaaactcaagcgaatggaggaggaccgggaacgttcaaaaatggaacgagagaatgcatgggtgattggacggaacgaagacgagtttgaattacaatgggatgccctggatggcggtttcacggctctggacaagtacgaaacccaggaggaaaacgaaatgtgccagctggcgaaatttggactggacttgtctgctgctgtgagatatttggctcagggaaagcgaagacggctagaagagccaacgcccgggcgggaaactatggcatagtatgtacactatacagtaattatttatttgcatcagctacacacccagtagtgagctgtaaccaatcaccatgaagcatattttttctttgtattgtacattaggagctgtagtacaaggacagtatggacaattccttgtgctgttctattgtgtacttctgcaacccaacaaatatacaagtagccctgctgtgtacagttcgattattactcaagccaaaattttaacctataaatgcaaaatgtcctacaaatagagagagccccttaatactcagccagtctgagctttctaccaatctccttgcgtcccagccgctcggtatcagccgcgttctcaaagtccgccatgtcaaagtatccgtaacctccaagaagataagacatctcctcgtcgtagatctctgtctcggagggcttcctggaccggggaagagttcggccaaagtgaacttgcttggtggtatgtacctgaggaactcgttcacaagaccgagctcgagaagcaccagcaggtcgctgggccttggccttggcgacctctcgaaacaggagacggatctccatcatgacagtggacagagtctcgaggaaacgagcagtctgtcgatgcttagaagatgcacagatggtgatggagtcatccttgatgatgtaaccaagaccgtatccatcgggagaagtgggaccgaatccgaacagcttgagagcagggttaccacagttggaagtcgacagaatggtgttgttcagcttgtcccatccgggatcagagaagatgctgggaatggatccaccagccttgggaagatgcacgtctcctagaccagtgatgggagtcatctcgtctccaatatcaactgcagtctgagaaccaatggaggtctgagaggtggttgagtcgttgtcatcagactcctcaagatatcgtctccagatgcacagaagagcgtaaagatgacgatcctgtccaagaccttgagaggacttcttagtattcttggtgtgctgctggcaagcctttcgtaggtactccagcttggtttcagcaggaaggtcctcgcagaactttcggcagaactcagacgactcctttgttactgaccgaatggactcggttcggccatgcaaaaaggttttggtcatagcgggctcgtaagtgcattccacacgtccgtaaagaacgtagtaggcagcctggaagaccatctgaacaaaggcgtcaggagaacagcccatctcacagatggctttctttccgtagtggttgaaagaaagacactcaaactcgttctggtggatgagatcggagttccgggtctcggcaaaacgtagagcagtttggagctcggggccaatggaccactcgagctttcgaggagtggtagacacgttaccgaacgaagctggatctcgcttcgctgggtcaggagaaactgtcttccaaagagaaggagcagctccagaaatggtgttagcaaaccgcagaatggagtcggtgtaaatgtcggacacaaaccgcagcacggtgtgaccatcgacaccagtatgctcgaaagtcaccccggcctttgcattctgagtgacgataatttgcagcttatcgtaccatctgttcgtgcatgttccgacctggacacccttctggagctctgaaagaccacaaagggcgtttcgggtgagatctgaaagagactcgggggctgcgtgatccaaacagacgacaaacagagcagagtcaatgagtttgagacactcgtagttggaagagtcggtggcacggttcatctggtctctgatagaagcccagacacgtcggttttctgtggtgagcactccgacggctccctttgcaatctcagtgataggagtaccctctgcgtcctggatgatagtctcaaagttgagcgcgatatccttttccaccatgatgaggtcgttgttgtcgtccaacacgtcaaaccagtagaactgcgatcggcagagcacaacaatatgcttggaggtggagtcagactgcatgacacagccatttgcagaggggattcgggcactggcaaacagtcgcgagtactggtacatgcagagctttgtgcctcggacgttatctgggggcagctcctctcgtcggagggctcggatgaaccgcagagaagatgtggttaatgtagctgctcgatcgacctggctctgttgaaccggggtggggtcatcttcaatgaggaagaaggggttgaggttgagaacgaggggggagtcatagttgagatacgaatcgtaccaaaactgctcaatgtatgacgatcggggctttccgtactgcttgagctcctcctggagaatgggtccgctggtgttgagaaactcgtggacagctctttctgttcgttcatgctcgtgggccgtttgcagcggtcgcagtgcctccagataattgtcacatgtgtctttgaggtcgggaatgggcagcttgggcagcgactcctggtgagcaaaggtgctgtcgctcatggtggatgtgtaataagcgattgtgtagttacgggtagtgtgggcgtgaggttagtgtgcgagtggcagttttctgtgcgctggtaccgctagtgttagtttgatagactgctggtggggtgtgtgttttgacgacggactggtggacacttatatctcgctcaggttgcagtcatgatgatgcgacagggtttgcaaaccaacttttgcaaacaaagtcaaaggttcagaagtccggggtgcatatgctggccgagctaaagtcggatcaccggaacgctttctaggggagctgtaataagtgacaacagatacaaccggatggaaacaagtaaacaagactagtgtggttagaatcaagtatactgtgtcatgaaaattgattttgagcacctccactgcaagcagtcacagcccatccacccactcctacactctccaattaggttgactgcaatggctatcgctatttggtcctgtattgtcctactttgccttttcctttgcctttctcttggtctccgcttgtccggggtaacattattacagctggtacaatattcgggtaaaagccacgacgttaggttcgtaaagtaggttcttgaggttcccatagtcatatattcctgtgtagggcacgggaccggtgggctagtatgtactatagtgttgaactggacggtacaacggtgccgaggcaaaacatagttgaacaagtagttctatgaaacaacgggtgcacaagggattcaaattgcggctgatgcactttgtgcttggtttgtgcatgccagtatcatgacctatcttgtgagacatatgacataacgaggaagaaaaagagaggtaaaaactgacttgcttcttgcgggacagtctggggtagcggggatcagcaaccttagcagtctggggcacgatcaacgaactatcggggtacagtacttacaggttcagtgacagagctcctcataccactttcacttacggaaatcgcggcttttagcccgagatcccagtcccactggctttcaagactcatccgagctgcatgccacatccggtattgcggaccccatgcaggtggcagcgaaaaagaaaaacaagcacgcgtactcgtagctaggagaagaaaggcagatacgagcaagagaatgagtaaacaagacgtcataccgtttgttcgagcttgcttgttccatgtctatactgtctgtagcctgccaatttgtctctgcatgccacattctatgccggatgtactgatgatttcttccgtcactagagattgttcacttgtaattacccatccgcgggccaactgctaaattactgtataccagctcaaagcttcactagttgaccgtgtctaaggactaataccatacatactggcgacaccgggcgcctaatattacctatttgacttgcgcgccagtccgattcggtcgagatatgccgccttctcgccccattctctgccgcctcattatcttttttctcgtcgcctagattggctacacccgttctctgcagcgtcggcaaactttaccccggaaagccggcttcctacgataagacaggttatgcagtagacccactacagtacagcgatatcggagctcggcttttgctccgatacaagtaattgaaatgcattcggatggttgagattaagagcttgcctttccactactattgaagacagttgtgctgagtctcataatgtaaagtgtagatgctaaattgcggtacctctactgtagctatatttctctgagctcagtctagacctccatcatcttttcctcggacacaaggactgccccaccattcctttcagatgaaattgtggcgttttcagatgccggacatacttccgtgagtggttgaaattgattacaagtgattacaagtggattcgaacgacactcaccccagtatcgtacattcactctatcaaccatactcatccgcctcatccacggctgaactcagatagtaaactcaccttggaccgacggagactgggatataaatataaaacatgctgtagcttcctcgctgctacgggaatcggcagctcggaggacccggcgcgcaatcaacgcatccgaaattctttttataaattccggtacgactatagtgattggagcagcttttggatatacacaaggtaggaggtttggatccacccctttgattaaactacttttgaaagacacacatgactccactcatttttagatccacccatagcatgagatgttctacaggtgatcaggatccgaacatggcccctggctgtgtactgtagtcagttatacgagtaatcaccaaacagatacttgtgctcgtacacctcattaccccttagctactcgtagtcttccatactctactctcctccgtaggcccagcaggtcacgtgccttggtatggcaaatggcaaataggtaaattcacgctgttttaattgcgacgtcgcaaatgaagggaatatatttccaagtactccctacaagtagttgataatgaaccattgtctcaataaatagtaaccccttctattactaatcacagctagaccaatagaactccgtacaattgcagagtttgggataacccagataccgcatcgacgcacctcaggccgggtaagctccgcatcttcattctccagtgcaactatctaaagcaaatcaagaccagattattggaacatcttaaccactcacacaacacacacacacaatatacaatggcctttatgcagcgatccatctttgctctccgagccgctacccccgctatgcgggcccccgctttccgaatcgccccctccatgcgacgatttatctccaccgagaccaaggatgccattgagaccgccattggcactgctcccgtggttctcttcatgaagggcacacccgagttcccccaatgcggtttctctcgagccaccatccaggtgcttggccaccagggcgtcgacccccagaagtttgctgccttcaacgttcttgaggacgaggagctgcgtgagggcatcaaggagttctcccagtggcccactatcccccagctgtacatcaacaaggagtttattggcggctgtgacattgtcatgtctatgagccagagcggcgagctcgccgagatgctgcagcagcaggatctgcttgcacccgaggaagaggagcacatggagtaagcgtgcgactactctgacgtggacggtgacgactgattacaagtcaggaggatatatatttgcaatgtacatattatagagtgttgttgttggtgattggatcgtagtttgtgcgttagtaagagtatgtatgtacacacattcaaggacaacatgtatcagcctcgaacatctcagggccgtgattaggatatgtatgtcgcttccgcccgagataatgtgcatacttacggaatcaattgctccaccttgtaaaacgatcactacatttggtctcagtagagcaatgaaagcttgtacatcacccatttgttcgagtacaatcccagtaaccgaactacagtatagttcacatatagcttttacgtactgctgaccatttgccactttcaatgttcatgtattaccctgctttttttgttcattcccttatccctagattagtaaagccttggtgtcgccttcaactcataagaccgctcagaaaccctgccctcatcagcttgacacagatagtgagaagggatgtccactcgtgcctttcagctggacccgatggacctttgagaacagctccattgagagtgggagcttacgctcttgatttgctgtgttgcaagggcactagtaggggtacagatgtcatttcagttcaaagacctactcttgtgccatctgcacgcccttgcagcctcggaccttttaccagatagaaaacatcatagaaaccccaccacacaagttactcacctggcatgtagaatgcttagaatcgcgggggtcgtcgttcaaagtagctggaggtggacatgaaggccacggaggtgtcaaaaacccactcgccgacatcgaggtatcgctcgatgtacgaacgagtatccttgttctcaaagtcgttggtcttgatggtgagaccagtagatcgcttgacaccggccagaatggtggagaccagaacaaggtcaaaggagaagtggaagagtctaccgagctgagttagcatgaggaggcgggtggtcgcacgtgctgatagaggcaccagcagacatcctagagaagtatgaattgcaggaggaaagcgtggtagcatttcaatctccctaatcagttttcgagttactcacagtgcccattatgcctggaaatagtagtaggaagagaatttttgaagtggcgtagagtacgtgaagtaaacatttggaacaatggggcaaataaagtttatgacaatcagtcagagctggctatttggcctgtctgaccgtttgacatgtttcgccacatgtttgctgttatgcgtaattaaaacatccgtatggtgaccgtgtgtgaattatatacactctcttctctaacctcgctactgtacactctacttgaggcatcacagacaccccttgaggtgggacaacctaattttctactcacgtgacctaatacatcgtcaacctaaaaaatacaccaaacgaaacgcataatagatcgtcacattacaaactacgcatcttacggcagaagaagccaaggaacgggaaaaaatggaatcggttccggcaagtatcgagacatacaagacgcttaagccgtccaaaacgctccggtaccaccataacgaccccatcacatcgctcgatttcgatgacactggagcctacgccgtcacagctggaacagatgaatccattcagctgtattcggctcacaagggcactcaccagcgatccagctactcgaagaagtatggcgcgcatttggcccggttcacacacaacagcatgagcatcgtctacgcttccaccaaggaagatgacacaattcgatatctgtcgttgcacgacaattcgtacatccggtactttagaggccacaaggacaaggtgcacgcgctcaacgtgtctcctatcagtgatgtgttgctttcggcatcaatggatcacactgtgcggctatgggatctccggtcgccccattgtcagggagttttgaacctggtgagcccgaatctgattgcatttgatccccgaggtctgtgttttggcgtggccaacacatcggcccaggacctgtctttgtactctgtttctgcatggggatccgaccccttcgccacgtttgctcttcctgctccccctggagacggatgggcctctgtagagttctccaacgacggaaagtatattctcttggcgacttacggagagcagcaccacgtcattgatgctttcacgggtaatcttacgcacaagctcgttggccaccaccccttaagacgcgatcaggacaacatgcggggcggctccactcacactgcattctctgtggacggccgcacagtgtttggctgctcgcgagacggcaagattattgtctgggacttgcaggaccgagtcgacgagcgaggacgactgtacccttccaaggctctcaactgcgcacccaacgcagcctcccctcagattcttggtgtcaatccagcctccatgcaactggccacagcagataaagagcttactttctggctgccggaaaaagacgtggccgagcctccaaaggaggcatagatgtggtaaaacctccagtctgccacagctgtgcacctcggttattatgaaacatgactctagtgtgcttgcgtacatattttcacgggggtggaccgaaaaggttctcacacgacagtatgattagtggtctcgacgcacgcaccatgggggtatcccaggttccatgcacgtggggaaagcctgcgtcagagtatcctgtgctctcactgaaccagtaccagtattgtacaatgacttgactttacaacgcacgttgttgtgttgctgttgctcgagtgttcctggcagcttgagcttgcggacctgcaaatgatcaaattatcggaccatgatgagatccaacttcctggcgctttcccacataatatctaactgaataatatataatgaaacacacaactgtggctaatttttatctctggctgtggtggcgaacgagtggtacgaaaagcacaccagcatcgaaaaacggcccgcgtaaaacgtcctattttgtacagtgcaagctccttgtgtggacgccatacgggaggatagagtatcgtgtatacagaacacgtctccttccacagaatgttttgaattgaaaccggtcagggattccagcagtagctcgagccggctacgacgtcttggggggattgtcgccatactcccgtttcccgtggtttcaactacgtactccaccgttcacattcgataaatcagaaccgtctgatatcgaaggtgccaaatgccgaaccggatttctactgcattctggactatgccgacatgcatcctcggccccgaccaccacaggtgaagtctaagaaattcgaagtaaataatataagtatcgctataagtgcaaaagaaaaaacgaaaaaggggacaaccaaacaggtgcagatttctatgtgtaggaaaatactatagcatgtgcgatgccagatgccgtatataatccaaccatgccctcgagtcagagaaccaacaacacataatttcgaaacatgcccaagattaagaacgtgtccaagctcagcccatacactgtgatccagtgcgacgcatgcttcacaaacatgtactacagagacgttttggagcactgtgtcgacgagcatcaggattggcttcatctcatgaaaatggaagacattgttagccggttcttctacctggttcctctcaaccagactctggacctggacaacaacccagactacgaacttggatctgcgtatagagcagctaccacacagagatctgcccttccccaaacgtcttctcgcgaggatcttcacaactggcctctagagaagcccctgctgtattgacttgaccaaccactcacacacttaactccgcatccaaaaacaccacctaacagcaacactccaatacaaagcatcatatacagcttccgtacattcatacctgtaacagtctctgctctgcagtggctggtctaatttataacttattattaaaatgaaatcatcaaaagggaatgctgtaagggaacttggagcacgttgagagtcttttcaaagtctccaagtcttcctctacgccaataaaggctctttcttctcgggttgcttgtcttccggaatgccctcgggaaccttgggcaggtccataggctcctcgatcttgtccttcgggacctcggggaatgtagtctgcttctggggcaacttggctcgttcctgctgttccagagcctccaactcggcctgaacgtcctcctcgtcggcgttagaaatgttggacatgagcatggccgaaacctcctcctggtatgcaataccctcttctgtctcatctcgtagtcgttcaacccgatccaatgaaatctcctgattaatctctttgagcaccttgtttccttgctcaagaccatagaccacatccttctgaaccaaagcaaactctatggacgatgtgagattctctagagtttccagctgttcgtctgtcttgattaacataccttcctggtactttttctttctcaaagccagcagagcccgcttcttgtctccctttttgagcgcatccttagccagttccacctcactgtcgagaacaacttggatcttcttcttgtattgcttaagcttgtcacgttgcagcttgagatccaaaattgccttgtcctggctggtcaccttgatgcccttggacgactggttgcccatgttgcgtgtttagacgttttgttatatcgtcatggagctatcacaagtatagagttgatatcatgcatgtcacgtgacaccgtcagtgaaaacttagacacaggtaaagttcatgcacctgaaattattttgatagcgatctgtctacgctatttagaagacaacttgcaaaaaacgacaaaatggcaggcaaaaaaccaggcaaaggcagattgcagaaacagcaagaagcaaaggtctatgagctcaccgtggatctcatggaggagaaatgccaggctgacgacactttttgcgccaagaacctgaccaacctcgaggtgtttcgttatgtgcaggcacgaggaggtcctactgggcgtctaggaaagcaggagctgggccggcatgttgacgcagccatcactttgttgcgacaagaagaggagagtggcatgtttggtggaaaccccgaaaacggtctgaatggagacgcgatggatgttgaggaagatattgatatcgctgagcctgccagtgggcctatttttggagctcctgcccccgagaagaaggaagacacttctacagcatccactccggctgtctccacccctatcctggactccaacagcatgaacaagagcgtggtgggtctgtggaacaccacgcctgctggaggtgctactcctacagctatctcgggagctgctactcctgtcgaaggcggagacaacgaaaagaagagaaagcgagaaaaaactaaagagcgagccgcaaagaaacagaagggtatgtatgaaagaaggaggatcactcagagttacggaacattggctaacacaagtagaacacaaatcagagctttccatcagcttagaagatctgggaggtatcgagaaggttattgagcagatcaccaagtctgttctggttcctctgacgcatcccgaggtctacaagactacgggtctcactatgcctcggggtgtgcttctgcacggtccccctggatgtggtaagaccgttctggccaatgccattgctaacaaggctcaggttccgttcatgtccatttccgcgcccagtgtggtgtccggtatgtctggagagagtgaaaagaaaatccgagagatattcgaggaggctcgggccattgctccctgtcttttgtttattgacgagattgatgctgtcactcctaagcgagaaggaggaggacgaggcatggagacccgaattgtcgcccagctgctcacatgtatcgatgacctgaacccggaaaagaatgatttccgacccgtgattgttcttggagctactaatcgacctgatgcaatcgaccctgctctgcgacgacccggtcgtttcgacgaggagatcgccatggctgttccagaccgaaagtcccgagaactcattctcaaagccatcacacggcctcttaagctcaatgacgacattgacttcgagctgctggccatgcgaactcccggttatgtggctgctgatctcaaggctctagttactgctgcaggctctatggctctggaacgagccttcaagcagctcgtggagaataaggaggctggtcaggaaacaagcgacaagattgaggagatcaaggatacagattctatggatgtggagggtgccccccaagatgggcagcccactgaagctgtcaagactgaaacagacagcataagtgccggtgatgtgaaggaagagcccgttgaaacgcctgttgagacccccaagcccactactgttatcactctccccaacccccctcatacttctgtttgggttgatttcctgcgaatgttccccaaccccctgactgcttctcaacttcagaacatggtcattgccctcaatgatttcctgatggctattcctctaatccagccctcttccaagcgagaaggattcgcaactgttcccgatgtctcctgggaggacgttggtgctctggctcaggttagacaggagcttcacatggccattgtccaacccattcgacaaccggatctgttcaagatggttggtgttgatgctcctggaggagtgcttttgtggggaccccctggttgtggtaagaccctgcttgctaaggctgtggcttccgaaactgccgccaacttcatctctgtacgaggacccgagcttctcaacaagtacgtgggtgaaagtgaacgtgctatccgacaggtgtttgagcgagctgctctatcgtcaccctgcattatcttctttgatgagtttgactctctggctcctcgacgagacgacggcggatccgagcattcttccagacttgtcaacactcttcttaccgagcttaacggtctcactgagcgaagaggtgtgtacgttatcgctgccactaacagaccagatattattgatcccgccatggttcgacccggtcgtctggacaagactctgtttgtgggcttgcccgacgagaatgaacggtttgaaattctgtcgaaggtgtgtcgaaagcgacccctggctgctgatgtcaacttgcggaacatcgttgcggactctcgatgtggaaactactccggtgccgatctcacccagctggccaacgaggctggtctcatggctctcagacagcaagtgttcacccatggagctgaaataattcacgatcacaaggcagctcctccaagcagcattgagattactaaccaccattttgaggaagccttcaacaagatccgaccttcagtcactgacgcagatcggctcaagtacgacgctctcaagctcacttggtaaggggatgacaaaaaaaaaactatagatacatgatgatgcaatgacagtaataaaatataccaatgtaatgcgatgatatttttttttcagtacgattttctactagtagtataaggatatgagaagaactacgtcgacggatgtgatatggaataccaataagttagctatttatacactgagctcgctctttctgcttcgcatggatcgaattccaggagtctcgttgcggcgttctccagattcctctccgtacatgttcatgaactcggcaccagaggacactgccacagattgtgtcagagccaagatacgcatgttcttgtcgttggtgacaagcagagctcgaacaacgcccccacgactgcccttttgcaacttgcaaacggttcgagtgatgagctcatccatggtaggctggccacgtttgggcagccccccgtagtcgttggtaaagcgaacaacaccttcggcacaagcttgctcgttgagagcagctccatcgagaccaacaatggttagactcgatccttggcccttggacttgatataggccagagcctgttgcgctagggtgctcgttcggacgtcacggttaaatgtctgcagtttctgcaactcgtgcatgaccataacaggcactttgatgcgcagccaaccgctctcaaccacagtgacgatgaactccagttcgttcagccatagattggtatcgaaaataatggccggctttcgttcacctgccagaggcgaagtggtcagttccaggttttcaatcttggactgaacgccacactcctggcgcaccatgtctcgttttttgcacaatgattgaatgtcatcagaagtcactgacgagctctctccaccaatatcgggcagaaactcatggtatgcttcgtactcggagatgtagtcaggagcttctgttttggatgccagacaagaagtcagctcgggatcctgttcaagaccggaatcacccagttttaacagtcgagtatcacatagctgtctgatgagatcctgagcacgctcgagcctagtacattctccaagagtgtagtccagttggccacccagagacatggtgttgacaatgtcttgagtatcactgtcaaaaggacaagacaagacctctttggcccatgagaagcctcgtagaagcagctcttcggggagtttggaaacatagcccttgggagctggggggagttcgcgagggggaggggcctttttgaaattaaaattggacccagttgtgtcgttgttgtcaacaggaactcgggcagttttacgctggatctcgttgagataccacagcatatccttccaagggaacctatggtcgagcacctcgaggaacactttggggtgtttggttagagccaacatgaacagcagccagggaataatgtgaggaagagccttatccgatgtgagagctagatgggcacgaagaatgtgaaatgcaacatatttgttcggactgggaacaacaacgttttcttcgtccacactgtttctccacactccagctagagctccccgaccatactcatgcaagccagcaatgtttatggcagcgaacatggcagatcgagatgccaagaaggggcttggggttcgagcaatgacagcgcccaaggaaatgagcttctgacggatgttgggaaagcgacccttggtgactccttcatgaacggagacgaaggagtccacgaccacctcgaggggttcgcgttcgccctgtcgctgcatcttggctgccccagcgttgaacagggcatccattgtattagaagcgggtgcaaacggaaccatacaaagtgtggcacgacagagagacaataatgactccagacggcatgcaagtactagagcaaagtggtggtgaggccgcccattgtcgttgtatgtgagaagagttcggctgtaccaccaatgggctactccacgccagtaaacggcatcatctgttcgaacagacatgccaatacgagcgagatccccaacagcttcggtccaagagggaagatttttaccgtcagcttcacggtcaaagtagggctctgctaacaagaggagtgtctgggcacagtgtctcaggtggtcattcaggtaacgggccgcgtaaggctgcaggttccgggcaatgtgcacaaaggcatacactcctcgggaccacagtctgctagggatgtcgtacttgttgaccagtccacgaagtgacgtagagtcgttgtagtgagctgctcgaaggaaatcgtagtgggcgtccagtagagcagcatgccgcttagtggcatctgccagtagacggttgagacgctcttgacgaatgtcagtatgctgtgtgatgcatggttcgtccttctgaggaatctcctgtgcgagtttctgcataagtcgtccacactgatcttccagctggcacactcggtggtagatgttttgaagttcctggtggacagccgacctggcaggagatgcaggtgtgggagttggagtactcatcatagaggcagtggatgtggtacttgcggtcggggaggacatggtggcatcattgtcttgctcttcccgcatgtcttcacttcgtttgttgggttggttggaggctgtatctctcgaccggcgtttcttgggtgtcggttttcgatcttctgtcagcgcagaaggcacggtcagatgcgacgaatggatggccggggtgacctggcagggctgcagaggcacgctgctaggctcaggagtcatagtcatagtcgcagctgctgagcctcgtgacaccacagatggtgagggcttacgttcccgatctccgcgtctgccattggcggtgttgggtcgatttgcgggtttcgaaacggaaccttcggtgacgggtttcttgttgcgagacgccggcgtggagggcttgggcgacttctttctggcgggacgtttggcggtttcagactgtgcggaagacacggattgattcggcgttttcttgtggcttcgttttcgctctttattgttggccattatatgcgttcattcgccgcattctctgggatgatggctagggtggtgagtaggcgacggagagtgcgatgcggggtgcaatatttccgtcttggctgctgctggtcgtaatgtacgtatgctgagtgatataaattaccttagttaggattacatacacaactgcgcttacgattgcttagtcagttgggacgcccacaaagggaaggccgtaatttctgtgaaattgccaccgtaaattagtctacagtaacaatctcaattagtcttggagacggcgttggtcattatgctttaaaatgagtaacaagaatggcctccctgtctgatcagttcttgagacatggctgcaatgagatctgcgtcttcctcacctatctcaggtggcatgcaacatgacaatgctcactcacacacgacatacctgtacttgtttttgttaacggttctacaccattggtccttgatatcacacccgaactagctgattatttgatgtttattggttttacacgtttgccttttctggttcgcaggtttgcctctggtgccgtccagggacagttacaactgctgcaaatctagggaaatttattcagacatcggcgtttgtgtgatgactaatcagttgctagggaaatgatcacactctgtccagatattgaggtgccagtatgccagcttgacaccgccgtgcccctcctgcggcctcataagtgccctccatcttcactcgctatctctcacttatggtccaaacttgtcgagatccagctcgtccaaacactcaatggcagtgccaatgttgtccatcatgttgttgacaccgactcgcaaagaccggttagatgcagcggcaaaatgaatcaacagactggaacccttggtggtcaactcatggctcagctcgtcggccttgagaggcttgtcctgagatattgtggtgcagacaatctgagcctgtctgtcattggggaacggaatctccacgtcactgtgttagttcgtgtccaaagcgagtgttgtggcttcccccacattctcctactcacagtgtgtatttgcctggcatggttgatattggtgtgaaacgtttctacggttgcatgtaggtcctgaactttgttggattgtgactaagatgtgattaaatgtgattaaatgtgattaaatgtgattaaatgtggaataagatggatagatcagagaacaatacgagagccgttgaaatggatatttcattgcatattactaatccaatcatgtgctccaagtgtgagtcgttcgatttataaaactagaagcctatgagcttccacgtgctcttatcacccccaatagtcttcttgctttcggacctttaaaaccggctgtagacttttggtaaacttgatatccggggatacttggggatcgtctcttggaagagtccttgcctgggtaccggtacttgtagctgagagaaacaagagcaatagagcaatactgtcattgcattgtgaggcttgcaaccagaggcatataaatggtttcttctctgagtactcttacgagagataaaaaatagctttcaacgagatactgtaagggtactgtaacaagctgtttcgtagagactctacaagaaaccaccttgtaaagcccgctgatgtagtacatacataataaatgtatttttcaccaaattgcagcagagtttaggcctttcagaaaccccgattcggtcgtatgatacgagacgaaggtttcgttgtcggctgagagatgctcgacattgaacagacactgaaactgctcaattacgagtactcgtatacaagaaacggacactttgtccccatttcatacaagtcaccctcggtctctcagggacagccttgcgcggcgtagtcatctgatcttcatgttatttgactcgtttgtcgatctaaacagagtagggttgcacagtagatacttctacattatctacgagcatccgagagtaagaagtagagttataaattaaattaatggaatcgtcgggtatctgtcgcttagttgttagcggcagagaagtaagcctgatcaagtcggttagaggcggacttcatggaagaagtctcggagtgcatccaggggaagaggttggcaatagagccaatgaactgcttgataaagtcaaggaagttgccgaagaggctcctgaagacgtcaccaatagtggagatgggaccgtcagtgaacagagagataatagtgatggcaatctgctgcatcaccttggcgaagccctcggaaagggggttgatgatgagagggccaagggtcttggcgacgtcaccgacaatgggcagagtcttgaggtcgtcaatcagagtggggaagaggttgttgatctgggtgacacccttctgcaggttgtcgtagacggtgcccttggacttgtcggggtgagtgatgatgtcaagggtagaggtgacagtcttgaggacgactccaccgaaatcaatgaagtcgtcaatggtggagtttgctcgagcctcgaggatagcaccctcgtggacagcgggggcggccaaggctgtggaggcaattgcaagggggaggaggacgttcttgatggcaaccatggtgacaatggaaaggagggattgaaagtgaaagaagagaagatgaaagctgatgatatcgaaatcagggagatctatgggtggtatatatatcacttctcgcgagtaaactctggctgattggactgaaagaagttagtccctactgtactccccttattgtccaagataggcatgatttcttttcataaagtgatcgtcatgaccgtcaggaggctgcatgagttcattatcatgtttagtaggtgtagatatcaagagaagctctgagtgacaagtgtcaacaggactgtgactgctacaagacgtcacctctaaaggccccatgtgaaccctagacagctactcaggttggtgagagggtggttgacaccctccaaagctccaaaatacgataaatcatatgaaataactagctgcagccgtctgctcatcttcttcaactgaatgttaatcccgattatctatgccttttgaggaccagtataaacgcaagatctacttaagggatttcagttaaaaaaataagatgagggagggttcagtagttgattgcttgaattgtagccccttatctcttcttaaaatcaatcgactacattgctaaacccatcccacatgtctcgctgctacccggggtcttgtaccgctcggtgcctggagcttgcatgcctcgtgtatcacttcaagacagtctgtatatttacgaacgggtaccttgtggtacctttccttcctttttggtctgcgcgagtcctagtttgggtgaaaataaggactcgagagtgccgatccgcttatctgtagatcgtctgtatagtggttgtggttgatgtttagactgtataacagcggaacaaactgccgatataaatgtcaaatgggccaataatggggattctcaagtctcaggagcccaaatcggcccacctgataattcttgagataatttattgcatacacttgtagacatatggagcttcacatgcagggctgttagtaacacatggtcacacctgtattctcggctctgtcatgaaataatatcgtcgttattttcttgttccgcccttcttctagttccttgctcttacttggacttgctatcctgtgacctttgctgcttagccttgctaattatcatgtacctgcataagcctgagctacaaagtgctcctcgagagcctggacttgccgcaaagctcaggccgaggacctcttgctttttctagctttaccacgcgtaaatttcgcgcatatttcacgctcgtgacagcttcccgagtgggctgtttgcagattggctgcaagacagccgtggaaaagaccgttgtctgagaccagtgtcgatagcacgatgataggcgacggtcttgtggctcatcaagtatagattcctcttaatgcctacaaactggctgtgtacgtcccccactcaaccacatacggtatctactttactgtatctcaattaggtaacttaagcatcgatgttgacagattactactgtagaatgacagctttgaactgtacgagtacggagaagggtaggtacgatacagtatcacgcacgtgggtatgtagtcagaccatctactaaaatggttttttcactgttggaaagacatgtctcagaaactaaagtctagcctcaacagaggagcgggtgtttcagtgagggaattgagcagagattcggcacgtggggttttttcatgttagggacagttgcaatgactcaatcaagcacgcggtcaccgaacttttctcttgcctatcagattagactgctccgcctctgtcaatccacgtcctctttattcgaaccgtgcccacatgatgattatcattgtgcattgtctccgcagcgtggagggtcaccatgcaagttagtatactctgtgtgcttactctcactctctaagcgtatgacagccgtgccgagtatgagtagtcgtagggttgaggtggctaccagagagagaagtggtttgactaatgtcgcgtcaggtgctctgggctgtaataacgtgcactatcgcacacaaaatgttcactcaagttaccccggaaacgttgtttggacgctcatcgcagatggtccatgcaccggtgcaaagtcctcagatttgcttttaggagatccaggaatgcagtgacgtgacgaagacctcgagacccactgtggattcaggaagcgtagagggagcgtttggatcgagggagcggtcccggagaagttcgggagacccccaaacggagatctgtcgatcaaatgaaacaccgcttgaactcgagcacgacgtcatgataatagaggcaatgatacaagagagggaggaaagggttcaaagaaatatgacgttcatgtgaaagacagctcgaacggagggggtaattcttcgttgctgagtgattgtcaagaggtgctacaagtacctgtacttgtggtgactacatggaggcgtttttgcccttgatagtgaattcagaggtgcatactctataggtacactggacttccctgtgtgtaggaacatacagtgcttccaaagtacagtgtacctgtacgagcattgtataagttacttactgcacctgtcagttgatcgagttggttgagtgatgacatactgtatcctcaatggaacccactcatttcatagaataacagtacaaacagtagccaacgatttccagtgcttgtagccagaatattattgcctgtaatcgtaccggcacttgttttacgatatataactgtcaaagttgcaaaatgtcttgcgtcagattattctctggcattgatcccttcatccatagctcacagtatccatggtgggtcggaagaagctgtctaagagacgacatccccaaagagtagcgtgtgtcaaaatcccacgatgttttatactgtcataggtccgttgcttgtacctttttcaattacttggcatgacttcttgcaggagggacccacctgacggagttggccgacatgtacactgtagctccaaactgtacaacgatattcaacacaccattacgtcccgctctaacaatcaggtgatacaaagccaagcaccactagaagccctcagaaacagtctgacccgggtctcttcattaagccggatttacatctgctacaataatttttgattcatttccagtattaaaaacccttggttcagtcttttttcgttacctaataataaccggtcgtatctccaaatagctagcgcaataatatcacggccgacgaatgacaccacaatccatgagataagccacaaccaagaccacacgtctcactacttcaacaacacattattgccgacggtcaggccgtcaggtgcaggtttctatgcatcgccaagttgcttttgaagtggcctgccgaaatcagaccacacatccacaccgcctgacgagagattgtacaaaagggcaacacaagtcggtgaactattcgtgcaacacgggtacaattctgagacttgatattttgtatcaactaaatatagtaatacacacgacaatacgttaaaagacaatacaaacagagaaataaagagattttgacatgttattaaaagaatattgtaaatcaatcaaaacaataattactatacagatccagacttctatatacgatccaatgaggtgtttctatatatgatccaagagttgtacaatatatgtacatgatacgcctataaaggcataccaaaatgtgggcgtcttcgtccttttagggaagaagagtccaatgtgtgaggttggcgtcaacccaaacatgcctcagcaagtagtaaacggccatgctggtggggctatcactgctgaggtgtatcggttacactccttttgctatgttagtaagtcttttgggagaagagagggggagtacatacctgttagtgtcgagtcaagaggaaaacgcaacagttccaatgccttaatgcacaagctcgccggcgtcggacacgaagtagtcctcagcatactcgtcttcggggaccataatctccttgagcagaccgcttccggggtcgtagacgacgccgtggatctggagatctcgctcaccctgggcctcgatgatcacagtgtttcgcttgagattgttgacctgggcgcacacgttgagctccacgaggcgggcacacttgtccttggggtcctcgatggcatccagcatggccttatgtcgcacctttgtgtctcgaatgggtcgcagccagtggtcaatgatacccagcttcttggaggtgagcgacgaccacactcctccgcagtcgtagtgaccgcagacaatgatgtgtcgcaccttgagaacctggacggcaaactggatgactgagagcgacgagaagtcagagtcgggcagcaagttggcaatgtttctgtgcacaaacacctctccaggcagcagatccagacagccttctccggctcgtgagtcggagcagccgatccatagaatcttgggggcctggccctgagcgtttgtggggaacagcgagggtctcactgatgacactcggttggcccatttttcgtttcgctccagcaatgtggcgagcgagtcggtggctccgaatcggaaaagaggtttctgggccattttactgtcggtggtgtgcgagcaggtgtgtgtgtgtgcgtgttgtgggggtagcgcgtcctgactgtggtcgtgggtacacgtgtggaggtggtgagagtgaggttgtgacgtcgacggagcggtgggtggggaggtcttagtgtgtgacgggggaaggcctctggttgggtgttcgttttgtggcttgtggctggaagcaaaggctcggctgacagatgcggggaaacggggtccttggagggatggtctagtgtgcaagactagccggcgaaggatttttagcgacgaaatggtggtagagagagggagggtggatggggggttatatctggtttcgagaagaatagacgagccgatttgagataaggtgttgaggaaatttctcccaccagaaccttaatgtaaaaatgcggccaacgtattccactgttgggtgattgggtaggtccggtgaaccaaggagaacacgagcagaagcagtgagctcaaagaaggaaaaatgaatggaagaagcaagtaggaagagacggcggcaacacaatgatggcgtttatctcttagtcagaccgaatgcagcaatggacgtcactgatacctcggcgttgagttgacgtgtgtatgtggcttttttgccctggtttttttttttcggccgttgtgttgaatggtagcgtatcaactggtctaagcggcccgttgttctgtgagtgcagtcggttttgtcggtgctttttgcgggctgggacaattgggacttgggtgttttttggggcgacccggatctgcgacgggaacagcaacagatttggaggcaggtgggtacactcaaagggcgtcggacaaagctgggcagggtgggggcaacgcttctagtctcgcaaagggctttggcgtcgattggggagttttggagggctcttggactctcccgttgactcgctatatatacgtgcggctacagacggggttagctctacacagagttttttgagtgtcggcacaacctcggactgaagcgctccgagaagcggccggagggtcaagtagagcaagtaaccgcaactaaccactaacgagatagttggagtggatgattaatcagagacagagagacataaagtcataattacatctcagatttgatattaaaaaaggctgcgtgtctgtgactatttctgtgtctagcgatccactttgactgctcttcattcatttcggcctttgatttgcggctctgaaaaacgtttttccttttcatgccttccactgccgatcttcaagcgagataattctccgtgagatcgatgaagagtaattatgcaggttgggtgcccaaaatacagggcagagaggtgtacgttaggagacatgtatacggagaattgggggaaaggggggagatgattaataacgtcgattccgagatatacaggatctccgtgaaaaatagacccccatgtcgccctgtagtcacccatcaccattataagtgcaattttatgtttgccaattaatagttgcaaacatcgaatgcccgggtttatgcaagtcgacctgtacagagtggacccttatctcaagcaccaatgtatagaagcccttggagagaagcgcgatgaaaactgtggatcgtcccgtactgtcatttgaccgccgattggtgttgcttttgacaaagcaaagttcctctccaagcctcctcaccacaccacaagtaaaatcgatgctgtatttccgtcgactctcccgaagccgctttggtctcgtgcaccaccaaggtgagatgactcaggctcagaaatactgttggataagaccaatgcgtctaatagtcgctggtccaatcccatagtaagtctttgggctctgtccataatagtgcctttcttcgatctggttggtggctcccctggaaaaagaaatgacgagcaaatgagggaagcttttgctcacaccatatttactgtacagtagggggagtggatcacgatgtcatttcgaactgttgtataatagaaagctattcttagccctcgtgccagagacggtctgtttactggtagatttcaactcgcatatttcctcggagtcaatggatgagggagtataataagtgcaagtcgtcgttagcgtggatgtgtctggttatttactatcaaggtgaactgagccgtgtctcggttgtgtatgattcacgtcctcagtagcttggactgggatatacagtcttattgcgacccatgaacttgaaggggctaatatgctgtgtatgggccgtgtgtgggccatgctttcttcggttatctctatggcatgtacaccgtgggatgccatgatgcaccaattatcagaaattgtggcctgtctccaagacgaattttaaaaaaaacggagtttccgaggcggtgccttggacatgttatcgtcatgatagcactgtcttcagcatggagctacaccccgagcttcatacattgccatcacacacaatgcgactggtatcatgggatcatacaaatctcatggttcttaagtacattatatacagtcctactttacgcaaatattctaattgctgtaattgtacactcgttcgttcgttggaatggatagaataaataaattcggaagctgtccagcagttctagaattggcttgggttagaagggctcgataaaaacaaccagcaggcaagaaaaaaatatcagggttaaaaagctctgtacttatctccacacgaggtttcagttgaagaaattcaacgttgtatttttatcatcagtaaagcaaatgttactgtgtcgaatgcactcacgtttttttgtctggttaggttggtatcttcggctctcaaatttattctctccgatgggcggtagggtaactgcgtacatctggtactttggagttaccctctttagggctggccttggttttcacacacaagcatgcgtgggttcaactctggctgttgccaaataccggtaccttgtagttactgtaaaacaaattaactgggcacaatattgacagctcaaaacgacgccagtgccggaaaaacaagaatattgctgcggtcatcgcatcagggggtcatcctgcgcaacggttgcgtcgttgtttacgcgtattccagtccactgtacaaatagccttgttttggccccgtttggagttggtgttcagacgtgagggacatcttagatgtccgttttcgatcagtattgattctcgtaatgagaggtatgcgatggcacgtaggaggcgttgtgtctggatcgtatggcgttacccatatatcacgcgcgcgcacgtgcaatgctcgtgcagccttgtgcttgctcatcgctagtgctcatcggagcgcccatcatgtctcagggcctgctcatctcttatcatctgagcttccagagaccgtgtttattcatgtttatttcgtgttgacactaataggtttacactgtagagagtatacagtgcggtgagaggcgtcgtaacgatgtcgacgtgaggtaaacaggatgaatacgtcctggtcgggcattggtcacggccaattgggcggcttggatgctgtcaggcgtcatcatgtttgtttccgtagttgtatcgctgttttttgtcttccattggacagtggctgtgtgggatgctccacttccagtctgcccccacccgtcgtattgtgacctcatccgacatttccgttaaccattacagtcttcacgccaaccaaatgattgtatagagttggcaggtctggtagagttcactataactgttgaagttaaaccaagtgtcaagtgaggctaagtatacgtaacgtggagtcgtccgtgtctgtcatggctcttctcttcccgtaagagctatacggccaaacacccgatccgcaacgaatcccatcaaagatctgacaacatattccggccgctccgatatgcaatgtgccacaccttccactgtgcctctcccatgtccatttggtatacggacgcagttgtaagtgcataaatcccacgagtattgttgtaccgtacaagtagttctaaaagttgcctcacggctcctgcacaagcacaagcacgagtacaagcactgtacctgtactcgtcgatgttttttttttttttctctctataataccacctgctgtggttgcaagctttcattagtaacccaataccagagtaacccatccaatagtatgtagaagagtaacccaacaatacagtagtgccaacatagcgcgttggaatagcgccatattcaaacggctcagctgcgaacgagctagtatgcggctgtgctatcttatgagaagtctggcgtgagccatccgcacctacgccgagggtgagtgatattttctaacgacctccaagcctttttcatccatagggttccactcaccttcactgaacccaatctcattcgagttcccaatacggcaggttagtgacctagaaataaactcgggaatgtgtaggcaaccaaaaaatggtaataaatgcagagtcaacaacaaagtcgagtggagataacggcacattctgtggctccggaatgtgtggatttggcctcatctggtaatctgagtgcggagccagcaaccgtgagcggattgaagcgcgcaaataagtcggcttaacgaagcacaaataccacggtacaaggagtccatacgtgtagcagcggcttgggtttcaggggagcgtctcttgcgaccaactgcccaccaagccactaattactcagctgattcagaggatcatataggggggctaatctgcgatgtcggcgggaaattattaacccagggctgtaatatttttttcgagtggaggtataggtgcatggactgaggggcggataagggggtataggagtacgagcactggatggaaccatggcacgaggaataatttcgcaatacacagaagaatcacagcaatcgtatcgaaaacgacggatagcgactacaggtgtagggcagatcagtgaccgctcctctgactctccaaaccagtgcacatcctagggcaatccgaccatccatgccgagagctaatgggttaactgcggatgtctgcaagtgcgtcagggaatgtgtatgtacgattcggacgtaattgaagtgcgtggtacagtgtatgtgaagctacagcatgtacagtatgttccgggtatcgtgcaagtaccagtagcatcttctgactaacaatagggacacattctatgggctaccacggagcttgtttaccacgacaactcatccaatggcagtgtgttgtgtgtagttttcttttagtggccccattagtgcttctcattgtgctagccaatctcgtttcttcagatggcgttgacgtgctcagataaggttttaccaagatgaataggggtccgacctgggctcttctttctggtggtaacacgcaagtataccggtagttgtggataccacaaacacaatgggctcaccatcagatacatatttccacaccgaaacgtctccagtcacgacttcggtaccaagacgcgtcacgtacgcccgactcacaaagaaataactttaccaaattaacgcagccaagcctgtaagcgaccgagcttgtgtcccaaaaaggaaccagtcataccgatttaaaaatgcaaaagaaaaagagtttggaaaaaaaaagacaaagtgcaatggacatcatgtagctgtgaaaacatatataatcatctcccccgtcccaccatcttgtccagcaaaccaacatctcaccctagtctttcttttacggataccaaccaacccccacactcacaatgaagttctccgctgccgctcttatctctgccgctggccttgttgccgcccaggttgccaacgttaccctcgtctctaccgagactgttgcctccaccctcctcctcaccaccactcactgctctgacaccccttgtcacgctgagactgaggcccccaagcccgagcccaagaccgtcaccctgaccaccactgacgtcaacggtgttaccatcaccaccaccttctgccccgagactgagctccccacccctgctcccgtccctgccaactctaccgttgtgcccgtcggccccaagaccattaccctcaccttcactgatgtcgagggtaagaccgtcaccaccactttctgccccgagaccgagaccgctgttcccaccatccctctcactcttcacactgttcccgtggagtccattgttgttcctccccaccagaacaccaccgttgttcccggacccgtccccaccgcctccaagcccgttgtgcctgaggtccccgccggaaactccacctccaccgttacttccatcacccgtgttacccttacccccgttccccaggttcccgagtctactctccccgagcaggctaacggtgccggtgctctcgcccccatggccggcctggctcttgccggtgccattgctgctctcatctaagatgcttgagtagccaccctttagacttaacttatactaattaattgtttgtatttagttacgagtgtgtctgtagagttgaagtaatatgaagctatcatgaagcgctctgtcttattggcactgatcttcaaacgctgataggattgtttataatagcttagataccgttcctctcgccaaaaaacttcctcatatcaacaacacagcacgtcatgcaaagcacaccattggatttacgcaacctccctccaccctctaatcgcaaacaaaactccaggccgcatgttttgatgtttcctcgtcggtatacttctgcttgtccgtatggttcacagttgcagtcgtgtcgatcaaagcatatctcttaatataacggaaaccgaaaaatgcacaacgcactaaaaataaacacactagcgcgtcgcactaaccagaaaaaaagccctatattaccggtgccgtcgagccactgtccgtgtacaacggcttgaccagtcatttaactccctaccctgagatctctcttctatgcctcttttatgtcccctcttttcatttgacatcgtatcggacaaagtctgattgatgcctggccagactggaaatatgtaaacagcactgtacagtgagattctcatgtcacgtaaacattccagcacgcgttgacaaaagcctatcaatattaagctctgacacaagcggctttgtgtaggcttaaagaggtaatttgaaaagtcaaatggcagataatttttctccaaccaaacccaatataggggtgaaaaataggagacaatcaggtgggcgttgagaacctggaggatacgacatattttgagattttaacataaatgagacaaacagagcgtctattaatcatatttttacaatggggtaagtgacttcctgagtgccgctccgacggaagattttttccgcactagatgaccaggccgtttggtgcttggcaaaagtgcgtcaaataacgtctgtctgtcagatcgcccagttatacgctctttctcacatctctgtgctcttgtgtcggctgcattctgaaacacgagtccgggtaatatgtagggggccatgggcgcctggcaacacgagtgtgattcaggggtacatgataaagcccatggttaggtgagactaaggtgggaggccctgttttgggagacactgaggtgtaagaatgcagaggtgttgccatggtcatttctaatgacaatattgtatgttggcatacttttgcgtacaatatcacgtattactgtggccactgtgccgcagtaggagttttgcatgcctcggtctaaagctctgagcacatgcatgcgactaacgcaacaggggtgatcgtcgactcgcagcaacgatgtaaaggcacgaagagaggtaaaacagtggcggatctgatcaggaaaaaacaggctccgttcaacggtgatctccaggccgatctacaagcacggtacgatacgatagaatcttgagtgtgctctacggacggagatattttgtctgtataatgtggagatatgacatcacactctgaacctacatatgttgagaagcgcccacacactctgagttcacgtgtaccaatgattatagttgacatgattcagatactcgtaccggcacatggggtcaattggaatgtgaccaggtatgcgaagtggctgcccaactattctcagccggaacacattctcatgacaactgggggtcatggtgggatgcaagatggaatgtgtgagcggaccgcacaagctccagtatatactgataatgtgatactatacaatacagagagtggtggccatcaaataagggcagattcgcacttgctgacgcatctccatggcatactgtaaaagtctgatgattaatcattgtacgagtatgtaacgcgtcagcccaacactcaagggaatgataacagaacaaaaaactaataatcacattgtttttcactaaccgacacaagatgagtacacttgtacttgcagccctcagctctcatctattattggtatatacatgtgagtgtgtgtgtgagtgtgtgtgtgtgtgtgtgtgtgtgtgactgtgtgctgagatgatctccaaaaggtatatacggacgatacttgaacaccacataggtcatcacttaggaataccgcttcttaacactggagttgttgtcggtgacatacgaatccattattcacggcttccgctattattttacgcaatggtcgatgtcctcaagggtttgcagcagtagaaggggtatgtctccgctttctaaaaagcggagacgagagagatcgacgtacaagtaccggaacaactgtcgccacaaggatctagcgatacaaaggcaagctgaaataactggcaaagaacattcgcatatatacaatagctacaagtagttcaatctctcatgtggttctagatcctcgacataccgtagacaactcagtagccaaaggcccttttttatatctcatccccagatctctcttaaatatttcacccgtcagatatatcctttctgtctggactgttcagtctgtgttgaatacacccccattgatgacatattcaaacgacagaaccaacgagacttgttagccatcattcggagtgacatctgagtatacctacgccgtgaaccactatctgtaaccgtagtcatcctccataactgagattcccctcttcaggttacttgtagtaactaccggcaccggtacaagtaataatagttagatctacctctctgagcttggtggtcgagtgtcattgcacgggtgcaagtaataccggtagctgtaaaccgtatcacaatacaaagtagaattagccgtagtgtggaagaacagtatttgaactcctagctcatattatgattgcgggtaagaatgttcacccggtccgacctactggggcatgtggtgtctcggtcgtattcaactttcgctagaagaccgtattcgaagagttattaccagtatgtactattatagatgcagaaggctgtgcaacgcggaaagcactacaagtacgatacagtacaagtatagtacaccagtagccgggaatggaagccgaatattattccagccgagacttttcgctaaagaaccagccatgaacaatgtcttttaaccgccacggaatccaaaaacgcaaatctcagacagcttccagactgcaagtagtgtatagcaccagtagtctggttcaaaattagaagagtttggagtgtaaaaaaagtgggcaaatattatgggcgatattgaattccatctaatcggatctacagtaacatccgctaaatcactcactgccgaagggttatatataagcaacctccacctggcgggtatctttgagcactgatttgcggcaccagctggttttctccacgtgctctacaagtacagtagctatcattgtggggaggggagttaagcctccgtgtaactactgtagctatttggctgcaaagtccgtaatacgctctgacacagaggagccgtgtgctataataaattgcggaaagacagtgtttttagcacccctcaacaccccatatatgcatctggggacgctgccgagtgataatatgtctgtcttcacggacatagcgggatacatctgagatctagagatctagctaatttctagcgtccaccagtgtaacatctctgatgatgaagtgaactttcggcttcactgactcaggtcacatgaccgagtttcaacctccattaggattaagctcaaattagggtaaaatctgagacagctacccagcctcgttgccagccacgacgactggagaggaggagatagctacgtactatggatagtctgcttggtaatagttgctgttattgtcaatgctggctttctgtaggtagcgtcgcaccatgcgggagaaaatattatgagcgcatgtaataatattttggacccgttttgcagtgtgccgtttctcgtaagtctattttgtcgagagaactgaaggggacaccgttccaagtgaaaagaccattggagagtgaataggggtaacattagggctaaaaactggcccaaaagtgctgcaagccgtgccggaacaccattgggggcccaaataatccactccgtagattgtcagtccgtatccagtcgtctagctgtgtttcttgctatatattgtgtgcagttcggcacatcatgcaggtgccaccagccgacaagtgggtgcagcaaccgtgggataatatcggtgatgcgagctcgaatctgagatctggcctgacgggtatcgccagccacgcagtatagcaacgatagggcccgagaatcgctgcgggctggctttgtgcggggggatgaaatgaatccatatatcatcgggctggtgatcggcatgcatgagtggggtcgtctagttcagcggcagaagtaggacgcacgttaactaagaagagtcccagtaaaacaagtagctgccactaatcagacaaaaccaccacaatcacagtcttgctttttcgccctgtcagatctctttcttgcggcatattataggcccagcgcaaggttactgaatatgaatgagagagtacatacaagacctgctggttcaggcgatgccgtgcggtttaatgcgatagtagcgagatcagtacagctcgttccgctccacagctatcatagatctcactactatccatacttgcaagggtcgtgatacaaccaacacgctactgcactctcggctacctacccctattctgacagggctctatctgtggcatctgaattagactttgcaggattaggttggccaaaaaaaaagaagatcctctggcctaaaaggcgaaaagacaagaaaaaacaggggcgggttggagaggtaaagggtcggcttatggcaatgtagagaccggaaaagacacagaaacaagcggggaaaagaaacatctgacactgaagctgtagaatcagtccacacaacccttgtaaaccactataactccagcctaaccactagtgtgcttctgccagggtcatcccctattttgcacatttagcctgcgcccaactctaactttcaacggtgcagcatatgctaaagttggagatgaatctgatctgagatttggtggtcgtataacttgtctgctgctttgctctgcatctccacacaaaaacaagcgccttgctcagctacacacccacttgtttccacacaccctcaccaacatgcggtggtttgtggttctcttgctaacactggtttcagctggcccgatacattggcagcgacagcagctacaaccataccgacactctttcgacaacctcgatctctactcacaagaccactttgacaccgaagtggctctcgacacagaccccgtcttgctggacgaacgacagacacaatgcatcgacctgtcggtggacttttgcagagagagctgccagagcatcatcacagaggtagcatcatgtttgccactgcttatgtcccgatgtctgtgtcccaagattgaaacgtcgctgcggaacattgccatctgtgtcgcatgcaccacccgtttccccatcatctcgacgcttggaaaccaggtagccggctttttgcgtatctgcagcgctgtccagcccccgcatttgcagttttgcgacattgaggtacccgaagccagtggcagctttgcgctctcggatctctctggtggtcttacagattcctttactgtatctgtgggtggtactcccaccagtctgcctagtttttctgtaacagacccttctctatcagggcctagtctgacttttgatcccagcttcagtcttcctagcttcagcggtccctcttttacaggaccctcttccacagagcctagcgttactgagcccagtttgacactgcccagtttcacctcagtgtctgctccctcgttcacagacccctcactcagctctttcagtctgcccgacgtcactttgaccggtccccccttcactagaccggaagtgaccctgtctagtggaaacatctcgagatctaccaaccaggtgtctaccgctgcaccctcgcattgtgcctcgagcagagatgcttgtattgcagcctgtgcatctgtgatcactagcatgcagcaatgcaacactctgtctcttcaaaagtgcctttgtgatgcgattgtcgactctgtcccggacgtcaacaactgtatcttctgcaagatggtgttccccgacatcggcactgctatccccaattggcagatcacgggcatgctccagtgtccaggtgttagtagggcagtttgtggcactgtcttgcctaccagtgtttcgcagacaagcctttctacttcatcttcgacttcgttggttgcgtcttcttctgacgcttctgtgtccggatcttctgcgtcctttcacacctcttcccttacaatttcagtttcttcatctcagatcagctccactgttaacagcacctctgccgtctccagcactgcttttgtgtcctctgacagcaccactgagtcgtcggtattcgaatcttcatcttcttcgccttcgtctactgttgctgtcaatagtagttctgttcctgtaactacctcctcttctcatttctcgagtgcagtgccttccagtcacagctcagctattacctcttcgactgtcgatactacagccatcaagtcttcgtctgatggctctggttcgatagtttcttcagcttctgtttcttcttctaatgccacatctggtatttttccttcggacatcacctcttctcaggtgtctaactctggttcagtgtccagcagctccgtccctagcagctcgatatcgagctctagtaccgattccagttctggcgtccccagcactgtcgactcgtcctcaacttccggcttgcattcttctgccgtgacaactggaccgtcttcatctctttcttcgaccacttctttctccaactcgacgactgacagaactaccgctgtcattcctcctggcacccggtcttcattcacagcttctcagactgatgtttcttcggggctgacagatagctcttctgcttctaagacttcggccgttgattcatcaacttccgagacctcagtctctagtgcaggaacgtcggcttccagtactggagaatcgtcagctagaacttcaaagtcaactgcttctgaaagtctctcgacttctgaagtttcatcttctggcgtgacctctgagttgtcagcttcctcaactgtgacacctgatgtctccagctcctctctgtcttctgatcctagctcgtctgtatcctctgatgcatcaagctcggtgtctaacacagcgtcggctagaccagtgtctagttcagatgtctccagcacgggttccagttctgcgggcagttcggactcatctgcatctacatcgggaccttcggccactaatgtcgcatccactagctcaagtggctccgcttctgtgtcctctacagacagtagttctgcttcttctgagaccaacagtggcatatcaagcaatggcccttcaaccgcttccacaaattctgcccctgcttctagttctgcttcctcaactggtcccaactcagactcaagccatgatcccacttctgcccctgctacatccagcgatccaagcagtactgcaaacagtgtttctcagagctcgtcaagtgcgtccagcttgccaggttccagcctctcggctccggactcttcaagcgtatctagttcttcggcttcagccagtgcttcttcgctagagtccagctcaagcagtgtgaccagctcgattgtatccagctctgcaggatccagcagcagcgacgagacttatacaggtacatctgccacttcaggctcgtcagcgacaggttcgtcttcctctgtctcatctgactccacttctgcctctactactgactcttcttcgtccagcagttcggcaagtgcttcgtctggatcttctgatccaggcactgcttctgagagcgcagctgcttcagcctctgcatctcggtctgcttctgcttctccttcagcctctgtttcttcggacacatcttctatcccccagacttcggctaacctggtgccttcaacccggtccattccctacaatggcactgctcttcctcccgtggacaatggtgttaaccccactgccaaccccacagactctcctgtgtcggctctcggagatggtgagtcccctgtctccgatgatagctccccttctcctactggtggtgctggagatgtaaacggcaatcctagcgatggatctggcgacggcagcacaagcggcagtaatggcggcgacactagcaacggttctggcaacggtgactctagtgatcctaacaataacgatcctaacaacccgagtgatcccagcaaccctggtaacgatcccaacgatcccaacagccccgacagtcccagtaatgaccctaacagcgctgatcctttcaatgccaataatcccagtgatcccaacaatccattaaactctaacgatccttcgaacaactcgaatagccccaatagcttgaacgatccctctaacgatcccagcgatccgtcttcttccggtgctgctggcgccaatggcggttctcctggtaatggaggctcttctgggggctctggcaacggtgggtcgggtaacagcggcgcggagggacacgctccggtcccagtccgcctggatctggctctggctcgtctggctcatctggaggtcatggtgctcctggatctggcagtggaggttctagcggcggtggaaatggtggtgggaatggcggtgacggtggaaatggcggtaacggtggaaatggcggtagcggtggtggaaccgatggtggatcgtctggtggcgtcagtggtggttcttcaggagggtcctcatcaggatcgtctggaggatctagtggatcttctggatctagtgtatcttctggatcttctggatcttctggatcttctggatcctctggatcctctggatcctctggctcttctggctcttctggctcttctggctccggatcgtcaggctcatcgggatcttctggctcttctggctcctctggctcttctggctccggatcgtcaggctcatcgggatcttcaggatcttctggctcatcaggctcctctgactcgggaactggtttttcgggctcgagcggtggttttacttctggcgacaacaacaactcgcctaacaactcgcctgatgctaattctcctaactcccaaaaccccgactctcctgacagacccacttctaccactcctcacaacaacgacggttcgcctgcttcgcctgtgcagcctcccatgggctctcaaggcacgattcccaatctgcagggcaaccgaaccaactctactcggggcaacaaatccgagggcagtaccacgtacggtggcctgggcggcaatggttccatgtttggttccgccgctactgcgatttccatgagtgtggttgttctgctgctgttctagaaagactacaacaaaaactcaagactgaaaggttttatttatttatagactaatgcatgatattatggtaactgcgatatagtacaagtacattactgtacttaaattggggtatattgtacagatattgtatttggtgaggttccctctcccataaagagaactgttctacccgacagacacttccctacacgtactggtatttggttaggggcatagtatgagaaccggtagatttactgtcaaatttctcgtgagtcaatactttaacccgacataatacctgttcatggctaatgagagcggttcacatcaacttgctataccaagtggtgatgattactcagcgtcatagtacatactgtagtttgtagtgaaaatggagcgttgttgactattcatgagatacaatgacccctattctgtagcatccacaggcaactcttgtcactgatgagcgccaacacagacctcacaaccctacaccattccactgtacactacatactcgtatgtacatactgtacatactcgacacattactacacaacacaacatctctctgatcctccataattaaccaaatatacatttctatatccttgcagtccaattaaaccacaagaatgcaagcgtgcgcctgcaaatgaagccagcgagttgttgccgaatcagattgaagccttgttaagtctgtatgactgtcgaaaagtgtttgtcgatctgtgaaagcgttcgatcctcgctgtgcttgcagttcccttacaaatggaacttcttcttatccttatccatggccgatcgatgctcccattccacctctcctcgaatgcctctctgaagacgtctgagtctcagggtgaactgaggacccaattcctgcagacccactcgctcctcattcttgaacacgtatctgtgtcttcggaagaagatccagtctcgctggttatgcagagtcaccacctgacgtcccacaaactccggttgctgaggaaacatggattggaacagccgtccgacagtcttacccagtcgcgtggaaaagttgttgagaatcagctcgggaatgtgggttgttgatcggccgtggcccttgatctccttaggcatcttcaaagatgacacggagaagtacatggtggggccctcgggcagatgaataaaggtcaggccgttcaccttctttttgtcctcgttgatcaccaccagatcagtgtagtctctctcggcgcacatcttggcaatctgcgtcattgtgaagtctcccactcgctttttgaactcggagccggggataatgtcgtacaaaaggtctgcaaagtcgtaggcctgtcctcgagctcgcttagaggtagtgatcagtaccttggggggctttccctcctcaaagtactctttgaactcatcctctccctccatctcctgagcgatggtctcatcatagactcgcttggcctcgatggtgtcaggcacgttctcagccagacgtttctctttgagctcggggttcttggcctcctccttggctcgttcccttcgcatctcgtgtcgctccttattgagcttgtgcttcatttccgcgaacaccttctttcgcttctccttgttggcgatccgaatatctcgctttaccgttcccatcgtgtcttgtagtgtgctatggtgtctgattctctgcaaaacaaatttcttgaaaatattggagataaaaaaatcctgcatgaactttatgcaggtggacagagaaggcagattgagcatacggagggtagaatgggggttgtgggggtgaatgaagtaatgtgggtactaagatacggaaatgactagaaaacctttaaaagaagctgccattattcacatacccccacgtggcagctataccaggactagtttatgcttactctctccgccatgttcattcagaataggatgtgaaaatgggacgtgaattgaactggcgttggagcatgtttaagcaagtttaaataactgtttagtgtagtctgccttctcactctcaaagggctataccagtactctgaacgaaggggttgtcttgccgcgtgaatctttgatatgtcttgtgctcatcctgcttgacaagatggacaaataactgaacgatacgaagctattggtgaagttcctgggaatggaggttccaccgtctcataacactgttggggccgagttatatgtcaatgggagaaagggagggattgatatattgatatatattaaaagcactggaggagtttcggaatcgtggagcctcgttgattccttttcacttggggacattgacagctgggagggacttacagtagtatgtgtcccatccagctgagaccagacaagtttcgaaatcaactaagggctcaagtagttggtttgcacacagacggagagcagacacaaagaaaagcggctcactgtgtgctctatgttagtgcgactggtttcattgaaaaaattacatgcatgaaaaatgagacgcgtaaaatcatttcaatccatcagacgcgaagcctgtgggcgcggtcaaggataggtacatactgtagctacaagaagtaccccgacaggcgtaggagcacagcattgggttgcacagcattggattgcatgggcgttggattggcgtgtctgctaaggcccatagtgcaagaaccagacataaaaatagacagaaacagctatccgagatgttagaaagttcatcagaacacacgaagcttgctacggatgtgaaagatctcatacaggaggtttggagtctctcatcctccgtggggttagggtaaaccaaaacaggcaaatgaatcagttgatcgagtgaactcatacaatgtgttgtgtcttgaggggttctcatacgttataaacaatagctggaaaaaaagaagttttgaataagcccattaccggttctcactttcagtctcctgttttggtcactagacattcacaaccccatcgatctacgaatacctcatactgaaatcaaggtttcaaatttcaccatttgggacggaggccagactgtgctgtaaatactgtcactttaaagcactagtacagatacgtcgttatcaccacccacaacacaccatggctatcttggaagaaatcgacgatgtggacaacatggactttgatcccgcggaattcgatccccgggcggttctcaccgacgccaccgcgcatcaggagagtgacgggcgaggtcccatcaacctgatttccaaggctgagcacgagcgacgagaacaagccaaaaaacaacaggagcaacagcaggagcaacagcaacaggccaaccccatggcccaacttcagcagatgatggaccagatgaaccagggcggaggtatgccccccaacatgggccagcagggcaagcccggtacacaggtgtttgactcggaggagttcaagaaccaggagatccaggagtccgactttaaggactggcaaatagtctacccggtctactttgacaagaacaagactgtgggcgagggccgacgagtgcctctggagctggctgtggagaaccctctgggccagaccatcgccgaagcctgcaagatgctcaccctgccttcaatctacgaggcgcacaagactcaccccaaggactgggctaatcccggtcgagttcgagtgcagctcaaggatgaccctgctctgggtctaccccctcacagcgtcaagaacaagcgacatttgttccgactcattgcccagtacatgaaggagcaccccaccaaggaggtgaccccttatcagggtcctgtgttccagaagattattcagaccaaccccgagttcccctggaactccaaaaacctacctcccaagccacagtacccccgaggttggaagatgcctgagattctgcctattctgtcacccgctctatctcatggagaggccaacaacgatatgatggagcagatggcaaatcagttcatgcctaagatccccgaggctcccccacagcaaaaggtcaagaagatgaaggtgcgagtcggaagataggttggaaggtatatagtataaacattggattaatgaatgatggatgggtagatgcggtgaaaggtgtttaatatgatgctagtttccaacacgccatggttattggctatagggcatacatttaagatcaatccgtagaagttcagtatgtacgtatgtactgtatgtactctagttgtaccgtaactacaaataagcatcagatacatccaactcacccttcaattattctactcttttatactcgtactgtcgcacccatctactccttaggcgagtactgatctcggtactgctcaatcttcttcttctcgtcctcggtcaagatgccatcggtgtactggatgacgtcgttgaggttgaagatgttgagaacaggcacgttgtaggtctgggaaacaacctgaacggcagacttggggctgtcaacagtggtctcctgtcgatccagtgcaatgaccacagcagagacggtagcgccgtttgcgtcaatgattgagaaggcctccttaatagcagtaccagcggtgataacgtcgtcgataatcagcaccttcttgcccttgagagaagctcccacaatgtttcctccctcaccgtggtccttggcctcttttcggttgaaagcgtactccttggtagcgtacttctctccgcccaattcggcaatcttggcggcggtgacggcggccagaggaatacccttgtaggcgggaccgaaaatgacgtcaaactcgactccggagttgatgatcacctgggcaaaggaagctccgacagtggacagagcgactccggtgttgaagagaccgaggttgaagaagtagggtgaagttcggccggacttgagggtgaaggagccaaacttgagggcctcgtacttggtagccagatccagaaagtccttcttgtaagcctgcattgtggtagtagtgataagagatacgaaactccgatgctgaaggtaagttttttttctgccattagagttgacatggtgaagagatggagatggggtagagaaggatatttgggggttatattttgaaggtcaaatagtatctgacactaggggggtcatttcaaagagtgctaggaacttcttgtctcaatattctggttggaatagggactttgagtcattattgcaactacttgtactacctttccttgacgttttttttttttttttttacttgggagattcatttgtagacactatattacttaaagacggaacgacaacaccctgatattctctacagaaaggtacaggtaatgaatatgcaagtgaagcagaacataagtttctacaccccagaggtgccaaataaggcttccaggtcacccagggatcccgcaattgctacctgtttctgatatcgccccgcagctaataatcctcaaggttcatgcacaacacttctacttatcaccacaccatgccgaccgaagagcaactccatgggatcatggaatcgctgcgggaggtgacaagaaagtccggctccgctccgacaacacccacaaaacactctccccgaaattcgacgctcaaaacagcaactccaaacagattcacaacagcatcctcgacatctggaaaaatatccaaacgaccgtctttaatggagcgaattagacaggtcaaggagaaggattatcgaagaacaacaaaggaaatcacagaactagctcctacgactacagcaacatcaacccctgctacatacactccgtggtccaaggaagactttcttgaccgggtctcgacatacacttatcaaaagtaccctattgagacgtcgctgtacccgaaactgagtccctataatgtggctcgttacggctggaaatgtacaagttcaaaaatgctccaatgcgtgagttgtgggagttatctggcagttgtctgtggagaggaagatgatgaagctaccatcaaggttgtgcaggataagtatcttgggcttattacacggaaccattccagtagatgcttgtggaagaacaagccttgttctgagagcctgggatcgatcatgggcaacattggacggcttcgaaaggatttaggaggaaaaattgcaattcccgagggcgtcgaggttactgtggatggacagagtgtggaggatttctttaagaaattacttcttgaagttgacggtgaagtaaacaaggaaatcgacgagaataggggactggatttgaaggaggaagtgaaagaaaatggatctggctctaataaggactcaaacgacctgacgcagtcagctgaacttggatccgactcaaaactcatcccggaagaagtgtctagaatcacactcgctgctggatggagaggatcccacaatatgttcaagtgccacgtttgttcaagaatagtcaaaccctctgagacgtttgatgtggtgcaggaacacagagactggtgcccctacgttgtggaaaaagagggtgacaagcccgcatggtggcaagtattgaccaagccatccaaggagtcttctaagaagcgtctctccaatatcagagaggtgtatttcggtgtatagaaacgtatttattattagacatgactagaatttaaaaggtaggagatgtacaagcgtacatacatacagatacagtatttctcgcagttcgtggagataatagttccaatacccactcatggaccaaatataagtagttaggatctgaaagcctgtatcataattaattcaagactaaggaagaccttcatatatattcatattgtccaaattcgcaatctttttattattctaggcattttttttattctaatctttactaacccaaaatacagctcgtttcacctttccgatatagtgtaggggctatcacatcacgctctcatcttgagaaccgtggagaccggggttcgattccccgtatcggagtgtacagccaactggctgtctctttttttattcttcttttccctatcatgtgttggtatcaaccaattttgcatgaggataagctgactaacccttttgacctgtaaccctcccatcccttcttatggggtacgtgaaatacgtctccgccttaaatctatacatataatcatcattcgttactatatacatgactactccagcacagtccacttctttttgtccatggtttcgtatccggggccgagagcggccactgagtacccggaggggttgacgagatactgcttggcaacccgcttgacgtcatcaacagccacatcaagcagctgccgtcgtcgcttctctcgctgctcgtaggtaagtccgttggcatagagagccattccctctgacttgacggagatgggggcatcgattcgctggaaaagggacagcttggcctcctgcagatcggaagagctccagtccttcttgacagaccactctccagcctcctggcaggtctgcagggttcgttccaagttggggtctcggtatgaataatatgagaagaagccgtcagtggggttataagaggctcctccaccgtaagcgcctcccttttctcggatttctcgatgcagatgcttgtgggtcagcatgttggcgagtacctgcaggggagctccgtcagcatgagtgtagggcactccggggatggcaataccagcgtagttgacctggaacggtaacttgaacaaggtgcttgtgggagtggtcatggggatagacaacgacgagatattgaagggcgactcattggtctcgaaggactcagcgaactttcgcaccaactcgtcgttcttggtctgcatgtcctggccacaagtgacggcaaatcgctgctcacgggtcagagcaaacttggcaatctcctggagcttggggatgacctcgtcgacaagctgctgctcggacttggcagccagctcagacaggaagcgcacctgggccacaccccccagaatgtcgtcaatcttcttgacaggggaaatatcggaagcagctcgaagcatggcgaacgagtgtccagactgagccaacgcgttggacaggttagcggtggaggctgcaatcatggtcttaagcttctcaacgttggtgaaatcagtgtttcgaagcagctcctgaaacaggccaaacatggtctccacatttttgtccaaagccacaccatccatagcaaagttgagctgggacgacggcagagaaagaggagaagaagagcaggagacagagaaatcaagaccaccagtgttgagtttgatttcgtcttccagttggcccatagtcttgtccttggttcccaaaaaggttagggacgaggtgaacagaggaaggaaggggtagtactcgtggggaagaccctctagagaagagatggagtggaagtaagtcagaccgttggtgggggcaagtcgccactggatgggatagggattcttggtatgctccaaggcaactcgaggcttgcttctggggatgtctgagacgtgaagagtgggcagacagtcaaggttctcaggctcttcctgcatcttttccaggttggccccggtctcgaagatttcctccttatcagattcagtcagtttggccagcttgtcggtcagaatctcgtcctccttttcctgcacattcttctcatagtcgggattggggttcatctgaaagtggaagtacttgttgtcgagcaagtacttcttcatcaccttctgcaggaactcagggtcggcctccatgtctttgttgaaccgatcgagcacagaattccactccagagcctccagggggtcgacctggttaaaccagccaggaagaacaccgttcataagagccataccgaacttggcgttctggtcctttcgagcaagctcagtctgatgcaaaagaccgtcgattcggcccttgtcgaagccctcagcaacggtagtcttgatggtgtcgagaataacagtctcgacctttgtaagatcgctctcggtcactccctgaagaccaacagagaaaatgttagctccaggagcactgtcaaggccagtgttgggagagtaggaagatccaagaccggaatcaatcagcttctgatgaaggggggaagaatgaccgtcaatgagtagagaagagatgatcttgacgcagaaagactcgtaaatgtccttgggagaacccatcaaccacgacatggacatcttgtgctgcttagacgtatccagaagagtgtcaataggaccctcttcaacgatacgggtgttctcagcggcagaagaaaattcgagaggcaatctctcggtgtttccgggagttttggagatctcacaattctcaaatttggcgttcagagcctccaaatggtcagcaacagagatatctccataagaaaacgtcttggcgttgctggggttgtagtgatcagcatgaaacttcttgagaccctcgtaggtgagttcgggaataacaagagggtctcctccagagttgttcaaactggggtagatcttctccaggtaccgaatgtagaaagcgtaagcagcattggacatttgacctttcatctcgttgaaaacgacacccttgaggatgatgggactggtcttgtccttggagtcctcgttttccagtctccagccttcctgagaaaagtccagctctcgaagcagaggcttcagggtagcatcgaggtacacatctcgcagattcttcatgtcggtagcgttggtggtagcaaaggggtaaaaggtgtagtcctgggcggtcatcgcgttcatgaagttggcaagagatcggttaagcatcttgaagaagggatctcggacttggtacttttccgatccacacaacgttgtatgctccagaatatggggaactccggttcgatcgggaggattagtcttgaagccgatggaaaagacgttgttggagtcatctcgagcaatgtgcagatgctgggctccagtggagtgctctagcagggtagcctgcagatcaaactcggggatctctttggttctgagaacattgaagccatggatattgtcgccgacagagagagtgggtgcggaggtggtggcgaaacgtcgaaccacggcctggaccggttttttgagcgactttagacgtaacatggtggtggaagagagtgtcgatgcaagtctcgattttagataaaagagtgaacaactctaaatgatttataatagttgggggaaggtagcgacgaggcggtggtcacattacaggaaaacaaatatggattgataccatgtaccatgagtgatcacgtgccatgagtgatcacgtggacagttttcgtagtcaggatttccgtctgtgggtttctggagagttgttagagcgtcaataaccgacatcttcctcgatgcggggaatagggtaagggagaaacccgtgaggtggcaagacgaagattagtaatatttataatgagtggaggactgatcacgtgataggattctacgatcgtgtggctaacttatgcttgatgggctcgtggcggtcgagaatgatttcttatctgtcttttgaacactcctggtgatgcataattaggttgcaaaggtctggaatactgatggaagaaatcgatttcagtgtcgctgctaagacgaggaggggacttacagagagaagaataacagcattaaaaataagggtgcctgtagctttcgatctatataaataatgtactacaatctcattacgttgcttaccgtaaactgcgattatttccgtaggtgctgtgttgaggttttcagtggcgactcgccagattgtcaaaacaggctattcgagtcacaacagaagacgtaggctagctactgtatttaaaacaagcatcctaatgaaagtacttgtactcaccttgtaggttgcggctcccagcaaccaacaaccacaattatttacatgatctgacaattcagtcaaatgttggaatcagcatactcccgtgaaaatgtggaccttgcatttccagggcctggactgtttcggtgggtgtttggatcgcagtctcgccaccagacgtttctttccaccaccttcgtagacctgatcgactgtttatagcgagaaacagtgggttctgtttgtggtgtgtaattgtggaggtcaggttggcgtcggagttgggactattaataggttcaggttatgacaagtatttttagcgacttgcacggcatgtacactatgaataagagagatgcacagagtcagtgagagattagagatagttgaacagacacgtgacgaaaaatatctcgtgacctattagttgcaattgaatcatatttggtaacgtgacacgctcacgacttccgcgttcaactaattaccacttctggacgcgtctcccaaatcatttcaattaagctcttgggtacgcgtcgtgaaggctgggccttgtaacctccttctttcctccacaacaccatggacagctctccaattcgactcatgagcgcaagtgagcagaatgcaggatgtgacaagcctgtaatggccgacaacaagcctctgtgcacgattaccacgcccgaaccgtcacccaagcgtcgaaagatctctgccgaggagaaagaaaagatgcgacttgaaaaggaacagatcaagaagcagaaagaggaagagcgagagcagcttcgaagacagaaggaagaagagaaagagctactgagaaagcagaaagaggaggagaaggaacaactgaggaaacagaaggaggaggagaagagggctaaagaggaggagaaacgacgacgagaagaggaacgaaagaaggctgccgaagagaaggagcttgagcgagccaagattgcagaggagaaggctaagttggctgaagagaaggaggccaagagacttgaaaaagaagctgaactcaagaagaaggagcaagaacagactcgaatcatgtctttctttaacaagaagaccaaaaagaagaccaagaaggaagctgttaacagtgacaagtgtttggactttgataaagacttcctacccttccacatcaaagataccgtgtgtatggcagacaagacggagtgtgaagtgatggatcaggatcctgttgactggctcaacagtctcaacctttctgatgacagcaacaccgccgaagcagaagaaccacctgttcccgtcaaaaccatcattactcacatccagaccgctgccactctgggtctcaatcctgataattacaacggtactcctttagacacgctggtcaatgctcttcctagacgatacttgcagttctatggtgacgagcgacccgcatacctgggcacgtactccaagagctgctcgcgtgatctgttgcagaaccctctcttccaggtgcctggtttggactacgagtacgacagtgaggcagactgggaagatgaaggagaagatattgaagatgatgaaattagtggagacgaggagatggaggacgacgaaatggccgactttgtgtgttctgatgatgccaagagtcccagcaccatgacttcaaaggtcacgacagcccaggaacctgttgttgtctggggctgctcagatatggttggtatgacttttggaggactgattgtccagggggcaattgacccattcaaagactattggactgttgcaaaagttgagcagaagaccgatactaagagtgacgtgacaatgactagtgcgacatcagcttctggtacagctattaaatctactacaaccaaaaccgaactcagcccgtttgaagtcctctccaaaactctgtcaccttccccagcggttgcttcagccacgaaacagtttctggctgctgccaagcctcagaagctcattgctggagacgacctgactgctcttttgaagcgagtagatggatccgacgataacaagacgctgttgaccgagctgctttgtaagcagtatccccagtacacacgcaagatggtcacggccaccattcagcactatgctgagcgacagggtcctaagagcgacaagcggtgggttctgaaggatatctaggccggggaatgatgagttctgctggagtacacatgacgcagtagataatgaattaacgatgaactgatgattcaataatgaaacaactgtgtgagaacgatggccgaggcctatactcgtaaagtagtacttttgtgcttgattccaccgccgcacttaaagggacgtcagaagtaaaattggtacagtacactgaaatacggtcacgtgactcgatcccacctctcgcctctcgggtaacgtatagccgatccatcctcatcctcatccttttctatgtgtagctgcattgcacctccatttcaatgtcgtacttataccaggtatttggggttgacatccttgtacagtatttaggctcagtgcaaaatggaccgtgaacccagtttcgatcgctctttcgacaggctctggtctacaaactcttactgtacatcgggcaaatcaaagaagacagagatacccgattggcagatcgacacaagtatggtttggccggaataagcaaaggcgcaaagtgtaatcaagatttgaaaattgctcatcgtggaaaaagaaacggggtgggggacatttaattggtagtgagtggtagaggtggtgatatatactgtgcacggttgttctatgaaatggaggtgagcgacttagacctttggagtaataagactgtacttgtgaaatgaaggcttcagtttacagcagtacataccgtagctgatttaagcctccttagcgtatgagcgaaatgtttcgatgtagcgcttcagatgggatattcccttaggaacgtactgtgataaacgggaactttaacaaaaagaggagtggattattgggacgatttcctcgcgagtcggcagtcacgaagttcagtgggtatttagatatgtgatcattatctgatgggttagtctgagaataccaaagaagtcgtcgagtgaagactcatacttttcacctccgtaacatgtgctgatgttctcgattgatgaagtccttcgtttgtcaaaactatttgtagttgtctgaagtcgcggactgctgagtctacttgtgccttcctgcggattacgatctccacaacaatagctactcttactcaatacaacaattaatcaattacttttggacgtctttcgacaataaataatgtcgtttacacgacacatcatcaacgatactcctccccttgattaagcccacttggccagcagggccatgagtccggctccggcacacatccaggcaaaggcccagaagattcgccagttgttggcgtgcttgaactcggacgagaacaaaaactcgtgggccatgagctcaacgagaccggtatacagcaggataccggaagacacggagtcaaagataccgttggtgatagaggctgtctttcctccaggagggtaggtctttcgcacaccgagaccaatggcaatcgcaatgggggtggtgaggccaaatgccagaccaaggatccaaggagtccacacctttttcttgggccaaggggcagtggccagtcgagttcccagaccgaaaccctcaaacatctggtggaagacaagcacaatgtacaggtccttgaactcgtctccggagacagcaagagtcagaccaatgaagacagagtggaaaatgataccaaattcgagcacaaaaatggaaacgagctgggcagagtaggtctccaaacccatgtcgttctccaaatcaacgtcgttggggtcagtatgctcttcgcagtgtccgtagtggtctttgggtgtcagggggtcatggttagcaatgggattgggcatagagacaggaacggaagagtgctctctgggcttttcgttctccttgacgatatcatcggaagagtggtcgtcgtgagagtgaccctcgtgggtatgctcgtgaacacctgaaatctccacgtccttagaggaagccagtcctacgggtccgtggctgtggccctggtgtccaaacatgttgaagcagaccagctccacagcaaacatgaagaagaccatgaagagacagataccaaaggcataggggtagtcattccagtgaccaagacactcttgggaaagagcttcgttggcaggttgtagaagatggagcagagaggtagcaatgatgacaccagaaccgaagtacttcgcgcagaaaaagaagacgggagggaccttgatttgcgagtacttggaacaaagaacagggaagagagctccaaacgttccgcagatgagaatgacaaagatggatgagattcgggcgcccattcgaccatcgtactcgttgccagagtcgcagacaacgggggcagcgtctgcatcgtcatctcgggtcagcagtctgaccaattgatcggtgatttcgggagacatgtttcagatcgagtgaactggtcgagtggaagaggttgatgccaagtgccaagccccggaaatgaagagatatttatctgggtctctgaaccgagatgatgagaaagcacctctctctttgtcttgtctgcactgcagctaagttgtaacttgaaccgtagtggttatgcttactgggtgcaagtgggtatgcgaagcgaaaagttgaaaatattttcagaatagaatctacgtattttgttcgcctacttccacgctatttcatccgatgctccaatcatcagccatacaacagctttcttggcaaaactctactcagtctctacacggctagcgcactattttttatttttttgagaggtgaaaacctccaaggtgctcgttaatctgaactgtaacctagcgtggaaaccttgacgtgttggatgacggcagggcactgctggtactgatgatacccggtcgtatatcagttgttgaagacgagaaactcgcgcggagcagcttgcagcctatagatcacgatactgccttttagtacacctcaaatagaccattcgtggtgccaaccatcagcgtcacattagctccaccctaccaactcctatcgaggcgcgcgctacagcaagggctagcggatacacgcataaatcgtagctatggaggtggggaaagctgcctgtagggaaacgtggaccaactgaattgatccctaaaaaactcgtctcaattgtggccatgacgtcttgtagactggtgttattaccatccagccctctaaccctcaaggtgcacgtctcaactttgtttggatgggtagcgaagagccgcttatccgagtcgtggtattacacatcctgaatactctacagtacaagacagggacaagcaagctatagtgtgtactgtagcatcgcaggttgtttttttttccccttggcgtaacggccggttgataagtcggcataaaattaccgagcactataaagacatggatcatcgaaaaaccgaggcatacttatctgaaaaagaaccgacgcattatgtactgcatgattacatactatactgaaacacctgcgatgctgataggcatctaaaaatcgactgtacgaacacttgcacatgtcgacatacgcctcgcacatgtaaccaaagacgtattcaccgtatcgtttcctttatccaagactgaaatctttttctcatcctataaattcaaggattatagcgtgttccgccagagtagccccataacctacacactaatagcgtgcaataggacggctctgatcatcgagcgtattgatcgtctgatgagctgtcttagattcgacattattacaagatcatgacctattggtgtcaagtatcactgttccaaagctatctgattcatcctctacaaggatggtgtgttcttggcctatcggtacccactcgaccaacacccagtaatggtgcttgcctccagaatgacacatgtatcagccttgtactcgacaaaacaacgaaacgagcagctctacactctccgtctccccctgtccaagaatacatggacgcagaaacttttcaagagtcacaaggtcacacgacacttatgcattatgatcatgacaccccgaagtccctgatatcacccatctcctcgcctccaccacatgttgtaacagagtacgcctccaacgtcccagccaccaattgtatctttagctgtcaatcaaccacgtgcaagtctcatctgaatcacgttttctctcgtataaacacacactctaactgatagtgggtcagatgctacagtacatacagtaacggaggggcagtgtgttcaactggacatgttcacatacattagttcgacccgaagatttgggaaatagtggacttaagcacagcaaggaaaccacctttgtgtacctatagcaggtgcccgagaaaaaattctcttcccgcaagttttggtggagcgctagaaagggaaggtgaatcagcaaacttggtgcgcacaaaagtttgacttgtagtagcaatacagcagacagaggggtttattattgttctgattgagcgactatgaagaagaaacaaagatattgaagggcattgggtaataatgaatctgtagttgccctagtctgtcttatggaccttctaacaatcatatcccataccgacaagcagaactgcaactgtctgacgtttatctgcttctggctgccctgatatgactgcctaatcacctacaaggtcaatagaaacaaacaaaagaccccctggtcagatgatggtttcgtcactagcaacggcacctgtttttttgttctttgtcagagtgtccaaccgccaacgggcttgtattaatgctcacgtgataatagatatgtgcaattattagatgatagagatctaggagtgttgtttctgtccgcattaatctgaaatttgtcatatcagaacattcattttatgatacaaaggctggccagtgacagcaacaagtgatatgaatatgattttggattgaaccgcaagtacaagtacaagtgtagactgatacaattgtcaacctttaccactcgcagtctacttatagactggatgtacttcatctcctaaattgtacagaacgatgttggctgtcttcttcaccagcgctgtagatcatcgaatagctactcgatgtcacaatgaagagatattcttttgacaagcctagggaattggaaggtcaactccatgatttcctataatccttggaacacgtcgtaatcagagaaaatcaggctctggtcattagaagtcacataatgaagtagaacagagtaaaaacgtactggtccatactacttgtagtatctacttgtatagaaaccattgacacaagtccattcctcgaaactgacagtcacaatagcgacaaagaactccgtggtatctgcaaaactccaatggttgcttaggtaactcaatgcctgcccacccatcaccacatatgccccattccgcgacatccaatggaccgaatttcgctgtagaaaagacagggcaccaataagagcccttggttgcactactgatccctgtaggtcctcttcagtgacaatactctgggatacagcaatgggaatccgaacttgtacaatcctgaaataaactggatatcaattcatagaaagaggagatctccaggaatattttgataccatgtttgtttgccaaattgacttgcgttcttggatagttactgtatactctcaatcgaccctgctctcgagagaactactacagtatgtgcctactgtactgtacttacataagcttaagccttctctacctccgagatggaacattgttcatccgatatattaatctccacaggacaaccggatacaacatcacaggcacaattttattgtaaaaataaatcaaacctgtaaaacatggccagattaacacagtaaaatacttataacacacgaaaaatcacatatattacccccagcaaacccctcagatttaaccagggttagggtaatacgtgcataagacattgcatatctacgtgtaactccatacactaacaatctcgagaccattaacaatcagggagggtacctacattcaagagtgagtatttcggaatcggagaagcgtgtggacgaccggatattatgtatacgattggtgatgtgctactggaattgttctgggtctttgtcacgatgcgatgtgactagtcgactgtcaagacgagtgaatttgatatcatcaagatgagatggacgtggagagtattgtgacacattggatgaggcgcaacaatcgcaagggactcgattgagagaactgcttgacgtttgtgtgattgggtagcccatatcacctgtcagcaattgatatcagaatcttgaatcgacatcgccgaagagagtcatatccaccaaggtggcatctgcttcagaatgactacgcaagcaaccaatattgcttgatatcttccgcttgagacgtacggcctcacgcttccgtttactaacccagtgccccccaattccctagctaaacagtatgatgccgacaaggagcggctcatcaagtcgtgtttctccaaggtcgatcagaccggccagttgctggagtcatacattacccacgttcgagtcaccgaggactcacattacccttcagctcgacctcctccggactcccccgttgctaacaagaaacctcgagtgattatcattgcagtgagaaagagtggacgtgtccgaatgcacaaggcccgagaaaatgccaacggcacattccagattggaaagacgtggaatctggatgacctcacgtctgtggagaacgacctgcagatccccagtggattcaccatgcatctcggaaagccctactattggatgaccggctctccaaaggaaaagacagtctttgtgagttcggccattcgaatctaccgaaagtaccgtaacggtgctgttccaactatgattggatgggatgcttcgattggatctcctatggtgggccagagtccaaagttcaagggtggacaacagcaaggaggacatggtagtccggttggaggaagccacggcagccccgggaacatgggcacccctcctcttgctggacagtcccctttgcatcctggacagtcccctttactacctggccagtctatgcctctgcagccaggtcagagtcagcccattaagatgggccattctggcagccctgtcaacgcaaacttctctggttcccctggcagtgctggatttgctggtagtcctggtaatgcagcgtatgcaggcagtcccagtaagacccacaccagtccatacaagcatgcccgaggtcgatccacagcttctgtcagctcagccgtttctatcggttcaggttcatcggctgggaactctattcctggccacggtcgtcgaaccagtgtgatttccatcaatgattcacctgttcctcagtcgccagtgcgatcgggtatctccacatcgcagtctgccaacaatgtgcgttctatggtggaccctgaacccggaatgaaacagactggtatatcgcagagcaagtcgctgggcaatgttgccgcagcagccgagcccattccaaagctcgacgaccatctgcttgaacagcagcgtcaggctgagcaacaacagcgacgtgaacagcaacaacgtgaacagcagcgccaggccgaactccgagccgaacgggaggctgaacaacgtttggagcaacagagacaggctgaacgacaggaacagcaaaggctcgctgaacaacagcgactggcggaaaagcaacgtgtcgaacagcaacgaatcgaacagcagagacaggcagaggctgagcatcagcatcgactggaactcgaccgactggaacgagaacgacaagaaaaggcgcgtcttgatttgcagcgacaggaacgggagcgacaggaacgagagcgaaagtcaagcgttagtcaggcggcagaagcggccgctgctgctgcagccgcctctgccgctgttgcagcagcagtttctactacacccggacgaaagtcttcagttgctgatgtttcttctgccgcttctgcagtcactcctcgtcgcaagtcttctgacgtcatcactattgaagacagtccctctccgcccacagcagctgctctagaaaaccgccagcctaccattccggtgatttccgttgacgatgatgtggtaaatgtggatgaagacgacttcgacatggactccccgaatcctgcacccatcgcaccagttgtgcctgcggcccttgctcacaaccgaagcttctctcaggaacttgcaggagctggtttcgtggaggagaaacccgctggagggtctcgggagcttactcgggagcccaaactgccagaatttgtggtcattgacgacaagcctccacccgcagttcaacgtcatcagcgaaacacgtctcagatgtcgtttgagagcaatctggagcccgtggatgagaacaagcaagttacacgtcatcagaagaaggtgtctttgtcagaaccatcctctgagggccttcctattgtcggaagcacaagaagagacagcacaggtacaggtggacatcgacgtaacagaagtaacggcagtttgggctcttctcgtcgtctttctcgagatctctcttcaggaggcaacatggctcccattacctatgttggcacttctcaagccgactctaccttgatcgaggacaccctgattgagctcaattggagcggcaacaaggatgccaaggaactcgaagctgacatcaaccgggagcttgctcagcttgaggagagcaacatttctcatgtcatcgatcttgacacaaagtttggcgatcttacgaccgaccttgatcaggctattgctcagtgcgacgaactggatgccattctcaccttcttctctgtggagcttgggggactgggatctgacattgattacattgagtctcaaggacacggtctccaggtccagaccaccaaccagaagattctgtgggaggagctcaactccattctggataccatgtctgtgccccagcgagagatggagatcatccgacgagttcgcctggactctgcacaggatgtagcatatgccgaggctgccttggtcgacctgttcgctgccctggcatctgtgcgaaaaatgggctccaactcacgagatgaggaggtgttcattggtggtatgcgtgctcttcaggaacgaagatcactgtacgagcaggctgctgttgatttcattgctcgagcccaggtgagtcttcaggagaaggtgagagatgctgttgtctcctccagcactcagctgagcgctgcctctgcctcgcccaccattcctggacttatttccaccgttaactcgctgtacaagtttgcgggtatcatcctgtttattcgagacgttgatcagacagcttactctgctattctcaagcagtacgagcgatctgctcgtgactactacgaggctgcctctaccgccttcttcgccaaatggaagcagcagttcaaggcgtctgacaagactgaccaacaaagcatgttttcccctggtcgggagcacgaacccactgagcacaaggtgtctgctgtgcgacagctaaccatgaaacgaagccatagccaccagaatgtcggccagcgaaaacgagacgtctctctcagtctcagcaagaacgacaagttacagaactccttctctggtatagtggaagctctccagactgctctgaactccgagcaggagattctaatccagctgttccatatgacgtcgttcggtgcagccaactacggtacttatattaagcagtatcctgctggacaacggctcgcgtttgctcgacacgtgaagaagcgaggtgtcgatcctgatcgagctcagactcgagctttttccactgttctttcaggcatcttcgcccctttctctcacgagtgtttgacctactttgagaacgtcatggagagtcgacctctggagtgtccgactcttttcgccgtgcttgatgctcatatcgagcccatggagagtaccaaccaggctttcctgctgactctggtgcacaagatctatgacaagtctgtgaacatctggaagactttcgtttctcgacagattgacatgatcagtaacacgcatgtgagttgcaagcgtcgatctggtgtcttgggctttgtggccaccttcccagagttctgcgagaaggttgagcagcagatttcaggcgagaagaatggagctgtgcgaaccttggtcaacgattcatacgacaagctaggcaaggccattttgcacaatctgcaacgagctgcagatgacgtgtctctcaagaacagctcttctggaggaaccggaaccgccatcaagatggcagcatctctggcatcttcttctggtgccaagggtgatgagcacgaggacaaggagattctcaactaccacattctcatggttgagaacatgaactgtctgatggactctcttcacgagaacattatcagccacagccatgtgctgattggacacagagacacagctgtttcacaataccgaactcacctgtccgagtactctgataacgttctccgacgaccgttcggtaaaatcattgactatgtgcagggtgtggaggcgcttctcaagaaggatccatcagccacccccaaccagaagcactcttacaacaaaaaggctctcaaggctgctatttcgtcctgtccccagaaagatctgcgaaaggtcattgatattctgcggaagcgagtggagaagcattttggggcatctccagacgatgatctggccactgtcgggaacgtgcctgtttacaacgacgagctgcttgccaaggtgtggaatgctcttcaggccgagactatttctgtcttcaaccgactgaccaacatcatgaacaagtacttctctgaaagcagtgctcagaatgatatcaccaaggctgagatccaggcagctttcgcacgatgatctatcgtatatacaggtgactagattatgtcaccgccccctaactattatagtaaatgtattgattgttttacaaatctgacctatagacatgtaattgacttacgaagatttctcaagccgtgtttctgtggaagaagccccaggagaccgagaaaatggagatgctggcgggaagctggaatatcgtgcctgatctgaccaagtcaacgacgaacttaaggggctagagaaggacgagctggtccgtcttttcaaagtgtttttggccatccggcccaagggtcggaagatggataacgagtcgactacgtgcattgataccagcctggtacatgattgacatcaaagagtctgtactcaaggtgaggttgttgtgtctctcctctaggtggcatacatatatttaacgccgtatcctgcttagaaacgtccgacgttgatacttgtcgacagtctgttgatataagaatgtactgcgtgattatattgacggtcatcaattaatccccatttggtcaccccacgatggctttctccaccctcttatatgtagataaaccccctgtaaagccaaagtgacagaaccaacaaagatcttgtttagtgaacgtcaagccgtctcataaccgtcggtttgcctgtcccaatccggctattcaaactccacactggaaggtccttctacatgctacctgtatagtacatacagtacatacagtacatacagtacttgtaattcgaggacttaatacatctccggtcaacagagcatatatgacacttgttaaatcactcagtctttccaagtacgacctcatgaggattttggccgctatcttcaattagcccaccatatccgacctcgtttgaaaccatcgagatcttggcagcctgttgttatttagtgccgaccccttttcggtcagggtggagatgaagaggagatgaaacgagtccataaggtggatttcgaggaacacaatagaagtggtcaatatatgtaggattgagatgtccacccagaattcattcatacatcaccgccatacctacttgtacacattgtccccaagtttcagtcaagatcctgagccaagaagcacactaacgcaatatgtatataaagatgggcacaggtaccaggaccgaaatgacatcaaaagtaaatcattgatcgccatgaaattcttccccgtggccctcctggcggctactgctacagcaagtctgtgcgttgactaccaggctgagaacgatcaggttctgcttgcagtgcagccctgtgaagagtcggtcactgctgcggagtccgaaatgagtattttcattcgagcagcagccggtcagcccgaagccattctcgccgagtctctcaaaaagaaacttgacattggtgacttcgctgggtacctgagaaccaaactgagcttcgataccgatgagcgtcctgtcaatgtggcgtctgcctttgcgattgttcctgaagtggagctaaagagcatcaagaagtacgagatccagaacccgtattctcttcaaaaacgtggagagtgcagtatgtggagtcccggaaactgtggtctttccgacgtccagactaactactatagtaacttctacactgtccacgcagaccccaaccaccaggtgtgtctcggtatttgcacggactacctatcgcacatttggaatgacggggtgctccagggctcgttctactacacctacaacggctgtaagttccgaagccagaacaactggaacggaaaaacctggaacttctgtcgagtgggcgcgttctacgtcatgaccaagtacgccatcttcccgactttgtacgccatagagctcactgggtgggttgatggtgtcaattatgtttctcctcgattctgtatgtctgctcttaacagttgcaactcagatacgccttccaatgcagacactgtgtgttaggccggtgggagagacactacagtatgtattagagagatgcaggtatattgttcaactaaagatgtaacaacaacgtaactataattccacccaatagacagcatggaggttagagctcgcgtaacaccctatcttaccgaagatgtagatatactgggagaaaagtgaaattgacaatcgctttcaaataagccaataaaccagttccactatttaagcaaacctctttccttatgtttacaccccaagcctatcttgccactcacaagttgcctcccacaacactgcaccttggacgataaggttttgaagtttgaattttttttgaaaatatattcagcgtgcatttgagaaccactccacacacagtacacaatgcccaaaccaaaggcccccacatccaagcgaacctctactcgactgagagagggtatcaagaagaaggctgccgcccatggtcgaaaacagcgaaagctcgccaagaaggacgtgacctggaagtccaaaaacaagaaggatctcggtatccccaactccttcccctacaaggagcagcttttgcagcagctggacgcacagaaacaggccgaggtggccgagaaggagcgaaagaaggaggaagctcgacaggcccgagctgaggcccggtctcgaggcgaggacgtgcctgatgaggaggaatttgaggacaaccccatggctgctctgttggccagtgcacgggctgctgccgaggagtacgatggcagtgatgacgaggacgaagagatggagagcgaggttacggagctggatgtcaaggtcaaccctggtgatgatgtgtttaacgagtcttcgcgaaaggccttcgacaagatcttcaagaccgttgtggaccaggctgatgtcattctctacgttctggactctcgagatcccgagggaacccggtctcgagctgtcgaatctgccattctgtccaatcccgacaagcgacttattttcattcttaacaaggttgatctgatccctgccgagaacctgcagaactgggtcaacactctgcgactcaccttccccactttgcccctgcgagctgccaactccggtcccgtgaccggccgacagctctgcaacaaaaacgtgacccagcagtccacctccaccgctctgctggacgccctcaaaaagtacgctaaggactcgcagcttaagcggtctgtcattgtcggagtcattggctaccctaacgttggaaagtcatccatcatcaacgctctcaccaagatccatggaggaggacgagcctgtcccgtcggagcccaagccggtgtcactaccgctcttcgagaggtcaagatcgacaacaagctcaagattctcgactctcccggtatcgttttcccctccgagaaggccaacaaggtgcaggagcaggcccgtctcgtgctcttgaatgcaattcctgctaagcagatggtcgaccaggttcccgctgtccagctgctgctcaagcgactcaccaacgacgagtctctgttgcagcagttcatggagcactactctatcccccctctgtcgcacgccaacttcaaggacttcaccacaaacgtgctaattcacgtggctcgaaagactggccgactcggcaagggaggaatccccaacctcgaggctgcctccaagaacatcatcaacgactggagagacgggcgaattctcggatggacccaggctcccgagtacactgaggcccttgccgacgaggagaaccgacctggtatctcgtcatctaagtccctcaaggctcccgccaagcagcaggacaccaagactgtggtccaggagtgggccaaggagtttgatctcggcggtctgtggaccccaggagaggatgacgaggacgtggacatgtaggagtgcaaaacggaaagtacacatgatatgtaataggttatagtatagagcattgtttggtatttcagagtatgtaggagaggggtacaaccaactacaacgtagttcggatgagatcaggaagtggacaagtttagcagtcacttctaaaccaagcatatgggggcgatttgaaggtcgtgtgtccatgcacttttagccatcatacttctctcgtctaatgttgatccatcatagcaatcccttttctgaccaaactaagttattattgtttcccgatttggacagtgatgaaggagtcacaagaccgttacagcagtgttttttttggcggctgtagtggaagtgagcaggatatcaacatattaatcaaatcaaagactatatatgactgttctggtacctttaacgtcttcacacgacctacaccgactatgtaccaccacccgtccgctcttataagaacgtccactttgggacatcggatatgcatacgcgtctaaccaccgccatttagtattttcgacagtgacgcgaccagctagacatccaagagacaaaattacgataatgagtgaactggagcagattcgtctggccaacattgagcgaaacaaagcactgttggcggctctgaatcttcccacagaggccaaaaaggagagcgtggaccctgaggttgcgccgaagaagagtaggaaacgaaactcagctcgacttgagtcgcctgacgatggatctgacgattccgcgcccagaactcgacgaaaatcgcgtcggctgcagggtctggatcccgaggcaaacgcactgaagcaggaggacctgggaggtagcggtgagctcaagcgactgatgcaacagctcaatggaggagtcaagaaggagcgactgtctggagatctgagtctcaaggagatgctaactaagactggactcgacgaaaaggagtggagtgcgtcgctgggccagctgtttggagacggatcgagggtcagtcagggagatttctttgatgagattgtcaagaaggaagaagaggatactaaggacattgacatcaagcagagcagagacaacttgagcggtctgcagctcggaaaaatgtccaaagtaactaaagagcgaatctacatcactgctgtgcatcctggtacagataaacggattgttttggccggagacaagattggagtgttgggtatttgggatgttgattccgataacgagcccctacagttgcaattgcaccacgctaccattcctgctctttgtttcgatcaaaattccaacgatattttgtattccgcttcctatgacggttctgtgagaagtctggagctgaaaacaggcaagagtggagacgttttggacttggaggccaagaagaacgccagtgttggtgtttcggacgtggcaaatccccaacctcatcttctttatgcctctactctttgcggtcacctgattcgaaaagatctacgaacgaaatcaactgaatatgagactctgattctcggagaaaagaaaattggtggcttctcggtggaccccatcaacactcatttgcttgcgaccggatcgctggatagatcgatgcgaatatgggacctgagagcaactgaaactgccagaaccattcctgggggagaagtcatcgacacacagttccagatgccccatctccaagccatctacaactcccgactgtctgtgtcttctaccgactggaacctggctggccagattgtctgcaacggctatgacgacaccatcaacatcttcaaccagagtgactacttcttggatatgttgaatgacggtaacggaacagagcctgtgaagaagacccgacgaaccagaaattccaaacttgctgaacccgagatcagcgaccaggagctgcccgaaatcaagaaaccttccgttcgaatcaaacacaactgccagactggccgatgggttactattctcaaagctcgatggcaacaacagcctctggacggcgtgcagaagtttgcaatcgccaacatgaaccgatacattgacatttattctggcactggtcatcagcttgctcatcttggtgatgccctcatgactgctgttccttctgctctggctttccatcctactcaaaactggattgcaggaggaaattccagtggaaagatgtattggtgggagtagagagtaatattggacacacattaatagttaacgaattatgcgatatgatatgtactctagagacggtcatttagacagcaccccatgatacattctacacttgaggtgttgtcatttatactcattcatgccattattatatactcctccatctaaaacaagccaagtagatcatcattggcttttccctgtccctgctgctgctgctgctgagcaggctgttcctttggtttttccgaaccgttgccaatattgagagaggcaaaggcatctgcggtgttaacagcagacaacgaagcaaacgggtcggcaggggcagccatgggtgcaggagaccccatagaaccacccatgccacccatgccacccattccgctcatgccaccgcccatgctgctggaatttccaaacagtgacatgatgtcgttcatggaagaagctccagtggcaccagaggcaccagaggcggcagcagcagcgtccgtgttgccgtctgtgtgcgaaaacagaccgtcgaggtcgttcaggttgtcggtgttggcagcagcagaagcgggagcggctccatcaaaatcgatgtccaacaggttctcaatgttgacacctccggaagcagctccaacagcagccgcggcggcaccgtcttgagcaagcgctcgctgctcctcgatggctcgcttctgtatagcatcagcgccaaacttgcccttacccatgaaagtagaggcaggtctgtggtagaccgatgcgagagtgcccagctcgctcagaagctcgtctaggagagcaggctgaacctcagggataatagaagcaatggggggcttatcggctccaaccacactctgggcgaaggccgtgtctgacgacagaagacgccagtaaatgtaggctcggtctcgaatgtcagcattgtccgaggacgaggtagcagtgttgagggtttcctggatcagccgctgaccctggtcgggtttctttacgtacagcttgaccacagctgtgagaagctgcagctgcacgggtgtggactcctccagaaactggggggttatagagcccagaatctcagccacgttggggacctggtcgacgtattcgcccagaatccagatgatggcggccttggcttcaggttcatcaatctcgtccatgttttcgcacagcaaggggatcacgggtgcgaacacctggttggagatggccttatcagccactccaccaggcaggtatcgtcgcagaatgtccctgaagacaatgaccacctcctgcagaatgtagttgatcttggtgtccaatagctcaagtagcagcgacacgcatttttcagccgacgaggggatcttgatagccagctggccaatggctctcacggctcgtcgcacaaagtcgatatcaacttcaagagcgtactccttgagctctgcaagcagttgactggcattgttgtcgttggccactcgcacgagaatctcgagcttctccatcttgaggtaggcggggtcattgtacttgacaaagaagactcggaggtctcgtgacagcagctgtgggtacttttgcagaatcagtcgaatgtttcgcagagatacgtactgcacctctgggggtgacgacgagcctacgagcgaaaccagagggggagaaatctttcgtagcagaatctcccggttctcctccgtttgtgtgtgcaggtgtgccagcacacacttgacggctgccagaacgacagacgggttggcatgctggaattggggtaccacacggtcgacaatgtgggtgccctcgtcgccatcggcagtatagtcggccagggaggtcagcagggtgactcgaccccattcggtgcattcgttgagagcactgagcaacttgccgagaatgtgcgaattaataacaaagcagtttgtcgaggggtctctgtcctgaatctcagccagggcgctgacggcgttggccactaccatggggttggagtcactcatgagtccttgcagcgtctgcaggaagccctcctccacacaggtttcgggagccaaatcaaacaacttggcgacacagatggcggcagtttttcgcacgtagggattgtcgtcgcccaaagtctttcgcagaggtccatccatgtagtcgaccatcttgtcaactcgaatacagcccattgttcggatggcgagggctcgaaccagcggattggggtcgccggagtctcccacaaaggtgttgacggcaagaatgcacagctcggggtgcgacttggcgtagttcattagatacagatagacgagtttcttctgctcaatgtcgtgggtggcgagatttttcataatgtccggaaacagagcagaaacatccttgcccagggtcatggcctggatcgtgcgttgaatagcctcctttcgctcggacgcgtactgcgacacgagtccggaccgcagctcgtacgtctcgccctttttgggcgcctggaacacgcttcggatccgtttttccaacgacattggtttgatggtgattttggttggtgttggtatatctgctgtgctgttaactatgccgcgggaatagggttaggtcacgtgttgggagtgttgaaacgtaccagtggctgtgttgcgcagggattatagcgattataaggctagggagttgatggatatgtgtttgggttcttaatttgtagccttcatggattatggcaattgattgatgggtttattggtggtgttcgacaccgcggtattgtatgctgagctattatgtatgcatgttccaatgtgtggtctctgctgcaccgttgctgtgcagcgttgtactgtaacagctgaaactttacgaagaactcagtggaatgacgagaacgagttcttggagctatactagtataagtgtgtgggctgttttcgaagtgcccgaaagtggagaccattggattttatatacgagtcacaaacgctggtttgtattgcttgatcaaagttgtggatgctattgagtggaatgaacagcctcggtaacaatggagttatcaaatagattgtgattacttgtgacaatagttaaaaaaagagatattgaactgcatgaagagatcggaagttgaagggtggatggaacagaactaatcagatgagggaatgcattcaagtacttgaacttgtacaatgtacttgtagaagcactttatatgacactctttttgagtgattgacttggttgatgaacaagtacttctacctataccaatcgcacttagtccgtttaatagagaccgtaacggagaacctcgaaatggagagaacgacagaagacctctgcaacgagtaagtacaagtacaagtacatacttctatatcttctaacctaccacgtggaagcaataacactcctcccccactccttactccctttgcaatagctgggcgacttggtgccgatgatacagctgaacaatttccgaatcccatgaggatctatctgagctttcatttagggaaatggaagctgaaatgctctaaaagaggtaccgaatagatcattgtcaacctacaagtagctgctctatgatcagatcaagcttacatttgagaagagacacgactgcgagacgcttgacactcagagataactacacattgtctctgtttagtttaacggtgccaaattggcgtcgcatgaaacacagattatcacaaggatctatagatgtatacggtagatacgagtacaagcaatagacatgctctaaagtcagttaccttgtgaaaaagatgaaccaatcattccaagtttatacagagtcataaccactgccatctcaaatcctccactgctcaccaccctcattgacatccagttcttggttgtaggtaggcttactaagctcaaacgaagaggacatacgatacagaagtgtgactccggcatctgaaaagcacaggcatgaaacattttctctcaatctacttaattaatgcaagtccatctcagccaggatctcacctgatcttcgacgaagtcggttcccctatttagaccaggggaaggggctactgtcaatctagacaatttgtagtgcctacaagtagccggtggtttaggatcagggatcgcctttagtgatcgtctatgtgaaaaaatttcgagtcgcaccttctccaacctccccaagtgtatatttctccctacagatgctctgtttacttctttctgagaagcaaaagtcagccgtgtatggaatgtacaatatgtcaacatgcacatatccatcagccgcgtgaaaaaaatacatgtaagcagaaaaaacacgcggcccagaaaaaatggagtggaaacttacaaagttataaacacgcgtccacgtgacggaatcggtcctaaatttcaaacccacattctgcccacatgggtgttggataccttggataccccgctcccacaataacattgtttaccgctgtcaatcacattccaaatcagtatctaatctttggcccaacttagtcggctaaaccaggcacacgttgatccccaaccttatatgaggtggagatatgtgtgtcagagtgcgattaatgaatgaatatggaaacggtgttgatagacagaataagcaaagggaaaggattgtaacggtatcatttaaaccccataatgccgtccggaacaccaagtttacgctttctctcataactgtgatcgtcgccaaatgacaacgtggatattacgcagacagaccagaagtccttgaggtgtttgtacagagcacagttttggtgctatggagattcagaaaaaaagaaacataacgagtacgacgataactacaaaaccagcctatcttggactcaagaagcaatattaccttctcaaaaacatccccctgaaccaaatgaaaaagttgagagtgaaaattattagagttacatatacaacagaaaagaaacatcctcaaaaggatgaataccaaagatataagtaaaccagccttggaaatcaaaccaccgaaccgtaaccatcggattgatataaacacctttccaaaaagtctctccttttaccctaaaaactaggttgcacgtttctctccatcccctaaccgcaactctaattaatcgcgatactactgtacttgacgacgttgtcctccacgtagcacgacacacaaaatggaaaaatcaatcaccaactcgccagttctgtcgatcctgtcgtactgcgcggcatctattctgatgaccgtgaccaacaagtatgtcttgtccggtacctcttttaacctgaacttggcgcttctggcggtccagtccattgtgtgtctgacggccatttccatcggcaaatctttcggcctgtgcaagttccggtccttcaacgccgatgaggccaagaagtggttccccatcgctctgctgctggtcgtcatgatctatacctcctccaaggccctgcagtttctgtcgattcccgtctacaccattttcaagaacctaaccatcattctcattgcctacggcgaggttctttggtttggcggcagcgtcacctccatggccttggcttcttttgtgctcatggtgctctcctccgtcattgctgcctggagtgatatcagtggagccattgctgtgtccggttccgctactaccacagtgaccgctctcaacatcggttacttctggatgatgtctaactgcttcgcgtccgcagcctttgtgctctacatgcgaaagcgaatcaagctcaccaacttcggcgacttcgatactaccttctacaacaacctgctgtctatccccgtgctcctcattgcctctcttctgtttgaagactggtcccccgccaacctggctgtcaacttcccccccgagtcccgaaacctcatcttcttctccatggttgtttccggtctcatgagcattggtatttcctactgctctgcctggtgtgtgcgagtcacctcgtccaccacctactccatggtcggtgccctcaacaagttgcctctggctctttccggaattgtcttcttcggcacccccgccaccttctcttctgtgtctgccatctttgttggcttcgtcgccggtatcgtctacgcggtggctcagatccagaagaagaaggcagaggctgctcttcccaaataaggagctacccacacttgtatttagcatgagtggttggagggttgagacggaataatccgtcaaagacgttacccatgtttttgaaggaccgagtcaagagaccggcccaaaagaacaagaaagtagaaaaatatattagagatattgagattggttgtagtgatcgaagtgctagccacatgtaccgtacgatatacccgccttttctgtgtggcttgctccacaggtaaaatatgacaatacaggttatgagcaacactaattgtacatactgtacatactgtaagtatatctccattcatgacatctcggtagaaggacaagtacttgtacatcatcatctattgcacatactctctcttggatatttctataaatgcattagattaagttagttttggacgtctacacggttgaaggcataccagtcaaggaagtggccgtcagtaatatgctggttgcggaactgcgtcagcgcagggagaatggtgtcgaaatcagcgcccttgagctgtttcaggcgaacgttgagctcgttcctgtactgcttctgctcctcgggcgagttgcctacaaaggcccgcatgatttcgagaatccgctcgttcttgctgagccgcagatcacgccagtgcgcgtactgctcacacttggagtcgttgcacacgccctggagctcgtacggacacaagggaagctcggacggcttgaactcggccaaagaaatggtatcagagtcggcgtcagccaaagagtcggaggactcgctatctacatgaaccggccgctgagcactgagtgtgctcagaggaccgaatttgtggctacggaaagccgccaagggagaccggtaagacgagtcttggatctcccgctccttttgcttggtgttagtaggaaatgaaatgaacgactagtgctgggaaaaatagaaaagcaacatagatcttgtcgaggtagaagagaaaaatgacgcgaggatcgaaaaacgaaatattgcggtgcaccacgcaaaaaaaagcatgcaccaaagaaagaaaataaaccgaatgcaactctttgccattccgcttccgcccgtgaaatttttcccgtgtcctcgccaagctcgtttgccaaccccactcagctcattcgtcactccaatttgttcttctgtgttagccatacttactacatgagcagcctggctctgctgttgatgactgtgggaggaaggtgctcgatcactagcatcgataccttctgtgtcactttggttaggttgccgggtggcagggggtggtatatcaggttggggtatcgaatgtggctgtgtcgcgctcttcagacttgtcgtgaatgcatcctcctcgccctgcaacaaggtcttgagtttgacgatctgaacaatcttgtccagttgaaccgcgctcagcgattctaatgcaatgtgtttcgagttgaggtacgcctggacctctggggaaatagcaggcgtcacagggagaggtggcgaggcaggagaaccgctcttgggggcagctgctgcgatttgaacgacatattcgagttttccagcagcctcttcaacaagagggctcttctccacgatggcagcagtctcgttggtctcgctggcctcactatcctcatggctgggagtgccgtttctggacgacgcgttctgctgggcaatcaaggcccggattcgtgcaatctctagccgcgtctcttccagagacatgtccttatgcttctttgacacaacaccttcgcttgcgctgtcactttcgctgtcactaatctcaatgcaaagtcgtttctgacgacgagacttctctccgaacctagggatggagcgaacgggaacgacgtacgcaggattgaaggcagcagcaccaatgggcggagtctgcggggtgggtgtgttgagctctgatcgtgtcttgcgaaactgctcgaaggtcatcaccggttgtgtgcgtgatgattgtgattgtatctgtgtctgttgaaccgcggccacaggggtcgggatagggggcatgggtgtttggaccaccgactcgatgctatatcccagctgcttgaagatatgccgcagaaactcctcactgcatccgctctgttgcaggatctcgtcgaaccgcagtcccaaacgacgaaggtcgaaaacagactggtagacggggtgaccacccagtaagccaagaaacgtgggtttggaggtggctggcggtggcggcgcatgttgccgagggtacggcgaaggcttctgccgggtgagcggaggcattggcgataacgccggttgcgtggtcactatcggcagtgcgggtggcgttggcaacgacacaccttgtggtacggggtgggccgagacaccttgtgttgttggttgagtatactgcttcacatccacaacccggatttcgtcgcctgcgggtggatgggttgaatttgctgtgtttttgcgcagcgtgtctagatggtctttgtgggcgtacagcgagttgagcgctgcttgccgtatttgcgctatatccatggcaaatgtgagggtggcacaaggatgttgagtgttattgtgtcttgttaggaagagaagagagagaaaaggattgtgaaaacgggtttagtatttaggctttgtgagggatactcgtagttgggtgggtgatgcaggttagggttgttttcatacttgagtacagtatgggtccacgatggttgttcaagccgatggggaaacgggtaattgtacgaggagcggagagggaaaggaatgggccactcgtcttttgtccagtaccatttaaggcaccgcggcaacagactttcacctctcgtactctttcggagaagactacgcacggtacgggtttatgatatatatctgcactctcttttcttgtgctccgaatacgagtggctcagctatctcaacctaaagttgtgttgagcgactctcaacttgagaggggagcaacacttgtacagtatcggcaagctgacacaaaattggaaagtacagcgtacaagtaccaacaagtagcgacggtttggaaattctaaccactctgcgtttgtttgaggagatgggctgctgagacacctcgattagtgaccgattgggttcataaccgaaaactgttcggctccgggtggttcagttgaataggtggtccatttggcaccttcgcagtgtccatatgcctcatgtagtctatgtcaggtactcgtacaactttcagttatgatttatgtaatataatatatatccgagggtacaagtacaagtacaagccatatcggcatccagaatgtatatgcaccataatataaatgacgaagagccggaatgacttacaagtacagaaaaatgaaccctaaaaatctgaatggatgttactgtaccgcagcggtgacgacgaagaacagtatgcactgtactgtagctacattgtatataacgcctattgctcgcattacagtagtcaatgccaaacaaccgactttgcactgtcagtgagtcgtggtgatgtctcctgaagactcttcgttggagttgaacagaccctgaacagaagggcaatgattcaaagaaagccctacagtaggtacatactgtacttttgttgtactcactcattctgcttcatgatactactgcacattccgaataatgacatactacgagtacatactgtaacgaagcactttacacttactgcggtacgttcaccatctcaaaccacctaaccgattacttatgaataaacccatgtatacatgcatcccgatcaacaagtgatcaaaccggtcacgcgttcattagaaccgtgtacacgtgaccaaaaaccaaaagtgtgtaatatgtgcaaagaacaaaaccgagagtcactagaagcacagctcaagtattcacatccttgtagccgtatccctgatactggttataattctgacccattcctaaacccataccttgccccattcccggggtaccgtaaaacctgacgtaattggcgtcggccacaaccgccgcttctcctcgagaagctccgcatttgagacatgccacattcttggcaaagttgtggtacgagcagccatttttgccgcacttccagtcgccagcacggaacggaacggaccggttaccgccgtggttaccatggttgctatggttgccatggtacccgttctggtagcctcctccgttaccatgattgccattctggtagccacctccattgctgttctggtagccaccgttgttgccagggttggcgttctgatatccgttttgtgcaccgcccatgttgccgttgtgacctcccactccgatggcttcgttgcatcggaagcaggctgttcttctctggaagttggagaatccacaaacctggcaagtccagtcgccaggtcggggtctgtttttgctggggggaaagggagtcagcagatcttgagcacgttcgatgacctgctccgaactgggactcacctcgaccaccttgtcgtttagagctctaccgttaagagccagagcctcgaccgcctcttcatgtgaggcgaacatggcgaacccgaaacctgtgggcttatgctgttctggtgttcgcatcgtccagaacccgatcggccgtccgccatgctgtatgaaccatgattccagctcgctctgggtcgtgtccagcggtaggttttccaaatgcaacaccttgcatcctccggtgagaaaagctctcagatcggcctccacgtcaagtggtcgggtcagcacggtgggaaattctctagcgggagccacatgcatcagtttgtgtaggcatgaagccaccgtggtgaccatgtctttggcccggggagaggtaggaggcagaacgtcgagagagttgcaaatctggatcagaggtgtgggagtggcaggaaccatgcctttctgtgtggcccacttttcccactccttggccagatcaaaaactctggggtgagccatgacgggaggcagcttcacacccttgtcacgcgactctcgttccaactgcacccttaaatcccacgagtccagacacacgtagacagtgccctcgtcagcggcgccggaggcagcaaactgagcgatggcctgttgcagaagaactcccgaagaggcagtttcccatgtaatacttgtcagctgtgtgcacaacggagtgatgggggtgttgactggtcgaaccaaggtggactggatgggcgaaatggagtctggcgaaacggtggtccacgcaacctcgatgatctccgtggagtctcgtgtcacgtagacaccctgttcgtcgcatgtggtgaggacatggaccactaggtatttcatcgttgttggaggtaagaggagttgtgatttagccttcctcaactttgtatgaccaaaggtgaaggtgacagtaaacagaaaaccctaacctggacgatatatatatacccatatcccgggtggcacgagtagcccttcaccaaggctagggtggctgacacgtgtggtttattgagatctctactgatcatgtgaagtgctatgtgctcattttgtcaattatgattttcggctgatatttctcttcgggttttcaggctaattaattagttgtatcttaatgtcggctttttttgttcaaccaaaaagtgcaggtctgagcgaaaaaggcgaattaacgtccagaagcgcgcaggcatttaattacgacattatgcatgcttattggacttaagctttgatatcgtgtgacacgcgacgaagaaacggagcgaagggaagtgatgttggcgtaggaaagattgtaaaactgagtctcttgggctgtaggtcactacaatgtagtaagatcttgagtacttgcaatgttggtgttttacaccactatggactgtttcagtatcttataatttttaggtggaccacttggaagagatacgcgacctgatagtggttactacgagtattgtagtaatgatttgttggaactacttgtagttcctttcaattgaaaaaacatcactattttgatgatacagtaacatctgaggagtccttttttcaactgtacatgtcgaaactattccaatgtcaacctgtatctacttagatgcagacaattgcgacaactgatacctcagcgagaagtggaacactgggcagttaataaattcattgaaaacgtgtaaaaaactacgaattttcttttaaactgtggtaattactcttttttgcagtaatggggtatcgtagcatggatgccagagaactaagatctcatacaacttacaatcctcaaaaatccaacactgccaataaatgccaaatcctggacttgcgttagccaagttgtttagtgcggtatagaggaactgtcatctgttcgctctccacgtgactagctctcattaggaacaactaagaccccctcgtttggcttagttcactttgcgtttagtcgactacagtagctacaagtagttacaaagtacgtagcgtagggcaagtagaatttatggaaagtacatgagttcatctttcggggtttccaagcagttcgaatacgggattctcaccgattttgcttctcattttcaacgacagctgtcaacttctgctgttatcagtcaaacagctcgatgtatttttagtatgttttttagcatcggactagtgtcgctttagcatgcaagtcgtgccaagggttgccaagtcgagactttcgacgaggtgacagtgccgtctccgaatattccgctcgtattattgttcagcgtgataaacaaaggctttactatttcttggacaatgatagacgtcaagggatatgctacacaagcattgtacgagaccgttgtcgcgccatatctacatttagaatggaggaggaggggaattgttagctgatgtcctcgagcaaaacacgtcctcgtttagcgacctgttctatttactactataactctacaggaaaagtcgatgataaggcgtatattattacccctccaggagatatgttgccagtggactgtttttttttttttaagcatatggggaattcatttacatttgccctgtgaacatgaatgtttcttttattagcgtctgactagcctgcttagtgcctatctctcgttatgctgtatcacgtctagagggaaattgtaagttatcactcaccatcgccatgagaatacaactcgtcgcagccctttgcggtttgattactaccgtaacatgtgcactcaaccttgacctcaactcacctgtatctgtcaacaatgctgtggctttggttgcccagggaatgctcgattattacgacgggttccgattcggtggcacaattggaatgtttgttcaaccgtactattggtggcatgctggagctgcgtggaacgccatgatcgaatactggcacatcaccggtaattcatctcttaacgatatcacttacgaggctcttttacaccagcgaggagaacggttcgatctcatggtgttcaacttctcctcctcggaaggtaacgatgaccaaggcgtctggggaatgaccatgatgactgccgccgaacgtaacttcacggcccccacagacgagtatggctggttgtacgttgctcagggcgccttcaacaccatggcttccagatgggacgacatctgtggaggaggtcttcattggcagatttaccagtggaactctggatactcttacaagaacgccattgcaagcggagccctgttcaacattggagcccgtttatatcgatacacaggtaatgagacgtatctggagtggtgtgacaagatctggaactgggccgaggctgtggatctcgtgacaaaacaatacgaggtgtacgatggtatcgagacaggttccggtaacgtgcccaactgtaccaaccgaactccgtacatttggacctacaactctggaatcttcatgcacggagccgctgccttgtacaacggaacgctcctgagaaatggaacaggttcggaaaagtgggggcaacgagtcagaggtattttcaacactgccgtctctcctctgcacttctttgggggtcctgaaggcaacattatgcgtgaaatcgcctgtcaacaggctacaattacctgtgatgccgatcagagaaccttcaagggcatctattcgagtcttctcggtcagactgctcagctagtgcctgatttggcccctgagatcatgaagtatcttgttcctagtgccatggcaggagctagaacctgttctggtggacgagatggccacacctgctctttggactggctgacaggcaagtacgacgaccaatacatcggtctgggagaacaactctcagttctgggtgctattctcaacacccaaatcatgagctcggaaggtccactggctgatatcactggaggagactccaagggtaacggatcggccggcactgtatttgagtctccttatgccaacaccattgctgcgccactaactattggacctggtgaccgagccggtgcgggtatcatcactgctgttgtgtgcatcgttctcattggttcaggatggtggttgctcactgacggcatgtacaaggggttcaagatcaagagaagagacccttcagagtaggttgattgatgtttgtgtaagggtattttattgtgtatttttggttggttatgttgaactgtagttgatgagtaaatagcatgtaatgtcgtgtatgaagcagagagtatgttcgacaaatgacgctcccaaaaataattaaagtacaagtatatacctaattgggatatccttagttacttggaatgttcaacaaattgcacatctacaacgctggttatagctccacatataaacatcagttttcccataataaaatttaaaaccgatgcatggcgacgaagagtcttcattattttccatgactctccaattattccaaattgttacattttagaccttccaaatccacctaccagtatacataacttcgctaaataaagttcaaccaccatcacgaaatccatcagctccaaaccagagcgtccaacaccacacaacactctacacaccatgatccgacctgctgttcaacgaacatttggccttaagcaacacatcggcttccgacgatactcgacagaaaagcccactcttggccagttttccaaacctctcacctccaccttcttcctcgcctccgccatctacacaaccatgcatttcatctggtggcgtctggagaccgacgagcgacgaagatcttatgccagtaagtatttattgaagggactggcgcattttgtgttgatttgattccccatctccttcaatgaccacatcacatccagtcagatcaaactaacacagacacaatcacttccctggaaaacgagctgaagaccaagcaggccaagcagtaatcaaaatgtacatatagacgaaaatgatattgattttatggaagacgtggtactgcacccaaactacaagtcatgtggatgggtctgtatcgaagatgggtgacgtgcattgagcatgatgaaggccatagcaggaaatctaacacaaatatatatagaataccaccaaacagcttaccaaatgaaagccctggacgagacaaatcgaataataccaatgattttatcctgtgaccattgaaagaggtgggaatcgcgaaacacggcactttcaactcaagccaaaagaaattaatttcgagatataaatacaaacaagaaaaaactaggttcaaaattcccattatgattcgacacactcaatatccggaatatcacacacatgtccatgtccatgtccaacctccattataggaaataagcttccagcatgcatgcctctcgatgcacctttttcgttacaacttgtacacgccctccgcaacacagactctagcttgacacaatcatgtcttttcagaagaaaaacgttgctgttcccaaccgggcggccgtagatcgcaactccggtaatccccatcctctcagaggtcctccagccaattcgtctcatccaagcgtccaaggtagaagccccagggctccctttacaggttccacagaagcccgggggacctctggtgtgacacacgctgttcaacccgtcccaaacacaaaaccttcacttttgcagtccagtacgccgaccgtgtcgtctggatgcttcgatttcgacaaactggtcggtcataacggcattcctaccggtactctgactctgctagaggaagaatcgactacagattatgccagcattctgataagaatgtttgcagcacaggggtgcattgatcgaaggaatggcgggtctgaggtggcggtggtaggagctaatgatgcatggggacgacaattgccaggagagagcgacaagaagagcaggtcccgtgatcccagctccaaggctggctctggagcaatgaagattgcctggagatacggctataacagtgaggtggagcgaaaagagcagcttgcagagaacaacacagccactttcgatctaactaagagactgggtggtccagagatctcaaagattagatacttgaaaccagataagtcgattgttcccgaaatcaaaaagctcgcatccgccgcggcttccgagaactcgattctgcgagtatgcattcccaccttccttcatcctgctatttatgataagcagatggctgattcagattacgttattggccttttcacacagctcagggccctcactagagagtacaagagacatcttgtcattatcgtgtctctgcctctggttctgtaccccaaatcgtctcctttgactcgatggatggaacttctggctgactgcgtgcttgatttcttcccttttgacgtcaaagtgcaggagcgagagttccagggcctggtgaatgtttctaagctgccatgcctgtctgacagaggtcacatgcttgttactcagagcgagtatgccttccgagtgacgaaacggacttttgagattgacgagtggagtatccctgttgaggaggatgacggagagaagaaggaggatgccttagccttttaagcagatggaatatggcaatattcgacaataatgatagcctagcttccttgagagtcagactaaaatgggccagtttattcaaacttgaattgagcccaagtgaggggtgtttgaggagcatctttcaaggcacttcagcatttcaaggaacagggtagtgctatacaggccaaacgcatatccttcaaacacaaccagtttctctatatttaaaaaactgacccttgcacgttgcgtcactccttgcactctttagtcgttactgtagatactgtcccggtcgagacagtgtcaaaacttgcaaggacagttacgatacttgtaggacagttacaatttagatccagtgaatagagtcctgactattgtagagccccaggatgggagcttatcgcccgtctcgttctgcgtacgttgtctcggtgttgttcgtttccaagaatggttttcccaggaacgggctatgaatgtacgaacaagtacgacacttcgactatcgtcgcctcaacgccttaccctccctcttagctacttgtaaacaccgtacatactgtacccacacatacagtacatgcagtagctaattacttggacttgtacagtagctaggctaccgcatccaacgtaagcttattgttcaacatgagacattatcgtatagacgttcgtaactgagccaggacgacacatttgcacaaacagttccgctcgctgtgtggagctctcattttgtttattttccatttggccccaaacctccaccactcgccatgccatatgacacacgtggttggacttgcatggtggaactttgttttgaccaaaggttggatggggctactttggtgcgatagaaacaggctgttagttgtttgatagacacgaggtggtccaaggacaacacaaaaaattgtactgtacatcatcagcactaccgtaaccacaggaggcgtcaggaacatcctatctatagcttccacaacacgtgtatgtagggtggggatatttgtgggccatacagcgagtttttggctgcctctgatgtcgcccagtccgaaccttcaaaagggtaaattgcaacgattcatgctgtcttttttatataatccaccaccacgctctcttgttttgtttcacctaatttacttacacactgggctcaaacttgcctctccttttgttcacactcagctcaatatgagagcatcaaattaggttcaccaactcctgttttctgccctgataactgtatccacagtttgggacctactaactaataacacatatcaccatcaccacaccacatcccagcggcaagatggaatatagcacgcctggatccgcaagcccgggggtcttccaacacacccaggtcgtcggccaacaactcgcccgtcatacggcccacatctcacgataccgaagtggccgatatgcccggtgtagcgtcctcgtcgtcctcaacattttcgtctaccagcaggttcaaaaacgcccggcagcggctgagccggctcatgagtcgtctgccttcattctcatctgacgcacgtgacggcttccgcaacggctttgtcaatatcaacggcagcgtcgcgagtggatggggggcctcttcttcctcttccagcagcactcctgtggtcaaaaagcgagacagagaagagactgcaaccaccccaccggctgccccaaccacaaaaacgcccaaacgagtatccacctcgccgtccatcacgtcgtcggcgctgtctcggttctcatggtccgaaagcgaacaccgacgcacactgtcgtcaaaactcttttactcgccacaaagagtcattggagaaaccgagtcaggaatcgccttcatcgacgatgtgccccagggcacggactttgtgtcgattctcccgacggaaatctccttctctatttttgcattgttggacccactggacctcgataactgtgccctagtgtcccgcgactggaaccgggccattaatagcgatccgctctggcgccaaatgttctaccagaaccgatggaaggctgtcacggaaccccacacatgctggaagagcctctaccgtacccgccacttgctagctcaacagtggggaactacaaaacacgcacagacacacacgcttgtgggccatcaagactcagtctactgctgccagtttgataacgacaaaatcgtcaccggctcgcgggataagaccattcgagtgtggaacgcaactacttatgtctgtgaacgtgtattggctggccacgaagcgtcggtcttgtgtctccagtttgacgaaaaaatcatggtgtcaggctcgtccgattactccatcatcatctgggatatggtgtctatgcagcctattcgtcgagtcataacacacacctcccgcgtgctttcagtgtgtctctccccggagtacattttctcgtgctccaaggacggcaccatctgtgttacgaagcggtctgactttacgctcaagtaccggctgtcaggtcacaacggacctgtcaacaacatccaggtctttggagactacatctacagcgcagggggcgacgcactcatcaaaaagtggtccctggccacaggtctgtgtgtcagagactaccgaggccacacacgcggagctgcttgcatagaagccaacgacaaattgatagtatctggcagtagcgacaataccatccgtgtgtgggacaaggacagtggcacatccaaggtgctggagggccacagcaagctggtcagaagcatcaacttatacgacgactacattatttcgtcgtcgtatgacctgtctattaagatttggactattgagggtcggcttctgacgagtttgacgggctatcattctggctcgttgatcacggccaaggctgaccgacagaagattgtctccacatctctgggctgttctcctgtgattttcgattttggagcgggtctcaaagaagagcacctagctcaaatcacgggttagttaaatagggattgtagcatatgtatttattggttgggcgtgagctcgtagtcacacttgtacagtatttactgtttatgatattgtgttgaactatagcaacagtaagaacgtagtgtagggctcaatgacaggtgacgacttttggcagttgtaatcaactaagctattgaacgtgtctcatatgaacgaagtcatcgcctgtcttcataactcaaaatatattactcaatacatgcgatatggctcgttactcgttagatgatcattgtgcaagtgtgtgtctgtgtgtctgtgtgtctgtgtgtgagagggagagtgggaaagagagagagagaactgagaattaatgtgaagggtgatgagggcatgcttcttacattaagcaggctctgcctctagttgaatcccactcgagctaactatggtactgatgcaacgaccgcttatgcctctgcaacagatcctttcttgaaaaggcactgctacactcgtcacatctgtgtggcttctctttcgtgtggctcagaatgtgcctttgcaaatgctcctttctgtaaaacgtccgtgtgcactggttgcaggcaaaccgacgcagatgctgtttactcgggaggtgtgccaccggtagaaggggtgcatggtgcggggaatgctgcatctgtgtggacggctgcagttgtgcatgcatgtagttgagcggactcggcggtggagtcacccgtttggggctggcctgcattggcatcagtttcgcctggtaaatgtgagggtgccgttgggcaaacacgtgatggtaatcggagatactccaatcctcatatgcccgcgccaatccgaggttatatgcgcccaactgctgcagtctcaggtcccactcgtggcgttcacgatgggggaagttttgacacaagaagtcgagtgcctgtggcgtcgtttgacacagacgcgagaagcgcagaagacaacagtcttccacggtgtcaaaatgtgggcttgttgggttttgtgggtgtcccccgtatatgggcagttccgacttgacttctgtataggccatcattttggtggtgacttgaggttgctgaatgggagtgtgtgatagacgggggtgtggtgtagtgtgtttaagaaccagactagcggggttctagactctgtgttagtggcgctttagggggtgaggcgtgtaggtccctgagatgggctcgttggcactttctggtcaactctacgagaggtatctgtgttcgttgtcgtttcgtctgtgtctgtgtctgtgtacttacgactgcgatgtagtaggggtataacaatgtgacagtatacccacaaatgattaaatcagtatgtgccttggagtagatcgtcttgttgttgcgtcgtcgaacgtgttgcacaatctgttgtcgagtatgagaactgttatgacgtgttatttgttattccgtttgctcagttgttccagagagatgtcgcgcaggtttgtaaacagttgttgaatagctatgtttgcctttgtgcaactgtatgatcgagtctgtgtgtttgttcttttggtaatattgtgtcgaggagctttggtgacttgacaagagcaaagtatcggtgatgtgaagaattctcgtcgagcctcgtatatttgcactagcgcatcacctgaccctaggcgacaccacttattaatatagtgtctcctgtggcctctgtatttttctcttcctttttgtgggggactattgtttgtccgtttccttgtctctgcgtggacgcatcattaagctttgccccagattttagctcgcccacttccccacacaactgcatgttaatgtggggaagcggaaaaatgtggaccacaacacagcacattacgtgcagtggaaccacatatgtgaagattgaacacacattttctgtaataaaatgtacgaagaactcatttgactgttaaatatatcctcacacccttcgcccttctctctacgtatattattactcccaccgacatggggtaaaagccctgcgtgatgtgcagttactccaaaagcttgagcttaatagttgcttgcagcaatgagaacagaagagacagttccctcagcaacttccggatgcgggaatgggagaatcaagaggggatctggacgtagaaaagcggtgaaaatggtgggcttttgaacgagccgctctaaatcagcctaaattcgtaatctatccccgaggctttcccccgcccttttcccgagtttttcagaccttccactcatcatttgctccactccattacatcgaaattaccccagtcgattgccacccctttcccctctttattcgtgtgcacaccttcggtgtggaacatgcagcttatgtggggggggcgttatactgaggcagactctggaattgcgacctacgtcctgacgacggaccgcacacagcaccacacgcgagagaagggaacataaataccgcatctttagacccacacactgcaactcccctttccgagcattaaattgtatttcttactaccttacggttccatgtgcggcctccatcgaatctgtcaatagacttctattagtcccaaagcagtgcttagtagcgtttttgtcccgtccgtaacaccaacaagttggttatctggaaagacgtagaagcaagatccggacagttctggccgcttgcagcccggcaaaagaggtcccattctacctcccacatgtcgtattttctttttcgttttcttgttcttgttcttgttcttgttctttttctttttctttttctttttctttttttttcattctgctgcttccgcaggtgcaaaatcggcgatgatctatttcatcataaaaccatgtttgaaacgagggaagttctaaacggcactaagccattcgtatgtaacattgagaatgccagaagaagcgacgctgttagtcacgtgagcaggattagtgtgggtagtgtttgttgagcgggcgccgatgggtctgtcagcttcccgtgacgatgtcacgtgacccagatgcacccctgtagttctgtgcgtctttgcatatttattttgagccaagtttaaataatccgacgcccgggggaggggaaattaaaatgtccgacagttaaggttttgaaattaaggtgtggggccgcaattaaggtcggaggggaaggggttagggctgcgtgagaatgggtaggggtagccgagctgcataaggaggaggtgccagaccggtagactaaaatgactaggtgagactttagttagacttagttgggtagtttagttatagagttgcgtatcgagatggctgagacatcgccacacaatgtctaggtatttggcatgagacaaggctgtcacggtacgtacctgaacggggtagatatttcgggagatttttgttggttccctacagtactgtaaaactgagtccggtgtatcggagtattatggtatggtttattattggcttgttcggatattcgaagtgaggcaaatggtagctacaacacggtgacaaaaaggcgcaaacaagaggctagacttgaaagatagaaggcaagtgaagtgatggaggcgttgaccaggagacgaaacagtacttcagtagtctggtttttctaacgagccaaatccatccacggaagtgaaataataaccgtcattggaatgttacagttgtcctacaggcagtctgatgagatgaaaaggtcgttattaacggcatgttgacgaatgaagttaggaaacggcttccgagaacatcttccatgatagatttcataatgagtgccaccctgaagtgcgcaacttgtaaatgccacacaatgaggctttgatcacactcacacacagacactcctgtggcctgtttcatggtgtcgaatgggcggtgtgggaggcacctcctgcatacaagtgatacatatattgattttttatatagtcgtgagggatgtagacagtacagaagtacatactgttcatagaatggcaatcatgcctagtataccttttaatattgtgcattgaaactattgcaagcggttgcttcacgattgaatattagcagcatctctaattggtaatacttggtcaacgtgtcctattacgacacagccgtgtaacttttgcggagttgaacacaccctgtcaactacgaccactacaagtacaagtttatcacccagtgagttaaaccatttttactagtctacaattaaatctcctcaatgatacactggacatcttcattgatgctctttcgaatcatttttctgagaactgttgaattaataaaactcagctaatacaacaatagacgttagattatatatacccattatagccctggtcatcgatctctccatctcatcaccgtgtctcactcgtagactttgctgaacatgtctcagcgaacgaacctttctacatctacagtgctatggttaaacctacatggagagcgggtacggggataaaaatcttctcgtatttgaattatcaatcatcatgaaaaaagtagcatcgttatcttttcagctgtctcatacaacccgaaagaccattgcattggcttctgtggactcgtagaggtgagttgatacaagctgtcggtagttttgctgagtaaccacctgtcactactgtagcaaaacaaacaaagctaacaaaatatgaaagcattgcttcacttaatctattatcacgtgatccatctcgtccccaaaccccctccacggtacagtgtttgtttacttttggttgagactgtctagtggtagggtcctgtgcatgctaatagtacatactaaatcgttcaatgtatctctacacagtaaacgtatattaacggtctcaatgacagagttcttttgtccactcaaatatgtgtgactttctgattcaactcctatagttttatttccccttcgctttctacatcgtcccccatctcatctttcaaaacctctcacttatcctaaacgggtatatgcagtaagagtttattttggtgactgtaagaaaggggtagattttgaagagtccttgaaccacttaatagacggttctgatcacagggttgacacgagaagtgtatttaattgatcactaagaccttatcgaatccttttccgtccaaaagctccaaaattcaccgacttctcctccagttcttgacttaccctactgagtcacgtcgtcccaatctggtcttgctaattgaaatcgcgtttgtcgcgtcagcgtaaactttgagtgaggtaacgagttttccccatcatcaacaccacacaacagcacgccatactcgacgagcacgcacccaaccgacacgccgagacccccattataatccccaagctctgcacacaccccatacatcactaaatcgtcatcatggatctcgaagactcgcttttccaggaccgttccaacctctttctggacctgctggactctcccactctgtcgcacagagaaaacattctgcaaatgctcaaccgcaatgagaaacggtactgtgtttcgctggacgaaatccgagactttgaccgacccttttggcaaggattgattgaccaccctacaccttacttggaggccatggacaatgctctcaaacagattgtgcatggtgttcgagacgctcgtcacatgtttcccgagcacgagcacttctatgtaggcctcacgggctctctcggaaaccatatgcgaaacccccgaactatcgatgcgaagctgttgggtcaactagttggagtggaaggtattgttgtccgaacctctctcgtgcgacccaaagtgctgcgatcagttcattactgtcctgccaccggtctaaccgagtccaaaacatacaaagatcagactatgggtgaaggaacagtcacccaggcagctgtttaccctacagctgacaacgacggcaacccacttatcacagagtacggcatgtgtacttatatggaccatcagaccatcagtattcaagaaatgcccgaaaaggcaccagcaggacagcttcccaccagtttggagattgttcttgatgacgatctggccgacaaggtgaaacctggagaccgaattcagatcatcggagtctacagaacccatggaggaggaaatggaagctcgcggttccgagcttacgttctgggaaacaatgtggtgattctgaacgccaaaagtcacgttgtcgagggagtctcggatgaagaggtacggcaaatcaacctcatcagtaagcgagatgatgcctttgacattctgagtcgatctctggctccttctattttcggattcgagtacatcaagcaggctgttttgctgatgttgcttggtggagccgaaaagaacctggagaacggtacccatattcgaggagacattaacattctcatggttggagacccctccactgcaaagtctcagatgctgcgatttgtgctcaactcggccaatctcgcaattgctactactggtcggggttcgtctggtgtcggtcttactgctgcagtgactatggatactgacactggagagcgacgtttggaggctggagcgatggttctggccgaccgaggagtggtctgtattgatgagtttgacaagatgagtgacactgatcgagttgctatccacgaagtcatggaacagcagactgtcactattgccaaggctggtattcacaccactcttaatgcccgatgcagtgtcatcgcggctgccaaccctgtgtttggacagtatgatgtcaccaagcctcctcacaagaacattgcactgccagactcgcttctgtcgcgtttcgatctactctttatcgtcactgacgaaacaaacgacgagaaggatcgacgaatcgccgatcacgtgatcaaaatgcacagatacgtgaaacccggcacggaaatcggagccgtcacacgtgaccagcctcctcaggtgcttgccgttggagagccagtcaaggacactgccgacgatcccatgtgggacattgaagagcaggtactttctgtcgggtttgtcaaaaagtacattcagtacgccaagtcacgtgtgagtcccgttctttcacgtgatgcctccaacctcattgtcgacacgtacacttctcttcgaaacgacgacacttctcagcggacagctcccatcactgctcgaacactcgagacgctcattcgtctctccactgcacatgccaagatccgtttgtcgtcacgtgtggacctggaggacgctgaggtggcacgtgacgtgcttagatacgcgctgttcaaggatgtgcctgtcgagtctcgtgtaaagcgacgacgacgagccgaggctgctgttgggcaggaggtcagtgacgtcgaggataatctggagcacttggagctctctgatgacgatggagataacaacgtctacaactcgcaagcgtctacagctcgtcagcggtcgttggcagctcttcgggcggactctacgttcgatgaaatgtctgatttcgttgttccttcttctcagcttgtgtctgagatcgatatggaggactctgtgctcagttctcagcctcgagcacgacaaggcctgtcgacttcgcgcctggactttttcacccgcgagttctccaacgtgctacgagcatccaaggactttgagaacggaggatccatgcacagagacgctgttcttgaggccatcaaccgctctatccctgaggaggacaagtttgccgaggaagagggatacgcagttcttcagcgactcagtgacgatggtaagatcatgttgaccgacgacggcgaggtttattctatttaagtgtttaattaattgttatagagatgttgatctagggaagtaagtagtggtgtacatccttgtacctgtatacaacacgagtacacattgtagtatcatgtaatgacatgaaggccatattcaattgtttacgagtacttcgaatcgatagaaaacacttatcacaccatattaattgtaccctacttactccaaatctctacttctacgattcttcctacttaccatgccactactgattatttcgctaaaatcgtatttctcgcagatatcatgcaggtggaatcggcacggcacacgttatctgcaaaatcactgaacaggacacgtcaccatttggagaacttttctgtgataatggtgagattttagcgcgtgtatggagttgaagtactcgtattggtaaattaaaaaagtcccagacttgttcagaccattagttctcgttctgcagggagtggaagattccagaacgttttttgatggttcggaactgcttgcagactgtacggcgtttggctttgtaatggttgcgagatggagatgggaagtggatgaaacaatcttggtggaatgaagtaattagaggatgcagtatggatatgaccatgtcttcaaaaaatctccaaccccactttgaaagagtgagacctgtggtggatcagatctgaaataacaattcgacaaaagccattatgggagaaattggtttcgttaggattggattgagatcctacatgaattggtgttgtttcactggaacctatcatctctttaatacggtctatgcactcgtcgtttcgcagcattcaatcatacccactaacgccgctaaacttccctttagatttcgactccccatattgggacttcgggaagccgccataacgttaccattatagtcggagtgcgttttctgttctgttcttgtgccctgttattgaagaaagacaagagtgctacaacttcgcgaatagcgcagttattcaaaatatgaaaacagtaatcgataccccactccaattggtgttggctgagtctttcaaactacataaatcgccccatctatcactttcgcgtacacttctcacgcttagtcaaaaccctaattgtgtcacctcacctttagtttaactctgtccaggtcaccttcttcatcatcaccattacgatgtgagtatgctcgtttgccgatattgcggaaggaaagccgactatacaaccacttgaattggacaatgtgggttgttttaaggtgtttactacccaccacctcgaagcgccactttcatagacatgtttgtgtcacatctccaacaatactaacccaggacactggtttcgtcaccttctatcgccagtgccagtctgcaccgggagctctcctccctggtgaaactgtacatctggccttttgtgattttgtaccccatcttcacctacgcctatgtgctgaaatacgacacctggatcaccggccaggaatggacatttctgtttctgggttccatcatgaccacccacgctctgacgtggctgggaacccactggaacgtcaacttcaagagcgctgttgaatcgcggctcgtctccgacatcaaggacgccgatctcatcaagctgttccctgcccccaactgtggcgctgccgccatggtgcccattgttcgaaaggtatacgaatccgactccactactgagatctcgtttgtgttccagaagcgacgatacatttggaaccctgaaaccaagtcgtttgcgcctccccatttcaccattgacgacgacaacgtgactgtgggcgagttccagacccctaagcccgtccgatcggacgacctggaactggcctaccgagtctatggccccaacaagttcgatatccccgttcccaccttttccgagcttttctaccagcacgccgttgctcccttctttgtgttccagatcttctgtgttgctctgtggtgtctcgacgaaaagtggtactactctatcttcaccctcatcatgctcgttatgttcgagtctaccgttgtgtggcaacgacagcgaaccatgaccgagttccgaggtatgggccttgccccttaccccgttcaggtctaccgagataacgcctggtccgagattcagagcgatcagcttctgcctggtgacattgtttccgttactcgatctggtgaggactccggtctcgcttgcgatatggttctgatcgccggtacctgtattgtcaacgaggcgatgctgtctggtgagtctactcctcttctcaaggaatccatccagctgcgtgaatcagctgccaccctcgacatggagggcgaagacaagaactcgattctgtccggtggaaccaaggctttgcaggttactccccctgagactaacgtgcacagcgatattcctcctcctcccgacgctggatgtgttgctgttgtcaccaagaccggtttcgagactgcccagggcactcttgttcgggtcatgatttttgctacagagcatgttggtgtcggtaacgcagaggccctcttcttcattcttttcctgctccagttcgccattgccgcctcctactacgtgtggaccgagggtgttcgaatcgaccgaaaccgatctaagcttctgctggattgtgtgctcattgtcacctctgttgttcccccggagctccccatggaactgtccatggctgtcaactcttccctagctgctctgtccaagttctacatttactgtactgagcccttccgaattccctttgctggacgtcttgatatctgttgcttcgacaagacaggtactctgacagaggaagatcttttggtcgagggtatcactggtcttggttccgagaacgacttcatgagcattctaactgccgcctctggagctgctatccctgaccagactgtccacgttcttgccgctgcccatgctctcgtccttctcgacgagggtgatgttgttggagaccctatggagaagaacactctggcctctatccagtggacggttggtgctcatgacgtcatttctgccccctcaaagaaggagcaggtgactgttcggcgacgattccagttctcttctgccctcaagcgatcttcttccattgcatcccactcttcgggccgaatgtatgtcgccaccaagggtgcccccgagactatcaagaagatgctggtttctgtccctaagggctacgacgagacttacaagcactacactcgagccggtaagcgagttcttgccctcgcttccaaggatgtcaagctgagcaaggatgagctcatccacattgaccgagagcatgttgaatccgaccttgtctttgctggtttccttgtcttctcctgtcccatcaagcctgatgccaaggagaccatcaagatgctgaacgagtcttctcaccgatgtgttatgatcaccggagataaccctctcacaggtgtccatgttgccaaggaggttggaattctgtaccctggccgaaagacctacatcctggacttgttcaatggcaagcttgctttccgaactgtcgatgaggttgaggttgactacgctgatcctgccaagccccttgattccaagtaccttgatggtacccatgatgtctgtgttactggatctgctatttcttctctcaccttttctcacccttccatcggtgatatcattcgacacgcctgggtttacgctcgagtttctccttcccagaaggagactcttgtgtcccacatgaaggatcttggatacatgactctcatgtgcggtgacggcactaacgatgttggagctcttaagcaggctcacgttggtgttgcacttttgaacggtactgttgacggtatgaagaaaatggccgacaatgctcgaattactactctccagaatgtttacaataagcagtgcgagatgatgcgaaagtggggccagaaggatcctcctattcctatggccattgctcacttgtaccctcccggtcctctcaacgtccactacgtcaaggctatggaggctcgaggtgttgagctcgatgagaagaccaaggctcaggttgccattctttctgctcagcctgttgttgctggacagcctcaatccactgctgctgcaacccaggcctctgcccttgctgataagcttgttggaatgtcttccgaggatatggacgaagctcccactctcaagctgggagatgcctctgttgctgcccccttcacctccaagctcgctaacgtttctgctgtcacgcacattgttcgacagggtcgatgtgctctggtcaccactatccagatgtataagattcttgctctgaactgtctgatttccgcttacactctttccattctgttctttgccggctgtaagacttccgactcccaggccaccgtctgtggtctgctgctatctgtctgcttcatctccatctctcgaggtaagcccatcgagaagctgtctagagagcgacctcagcccggaatcttcaacatttacatcatggggtccattctcggtcagtttgccgtccacattgtcgcactgatctacatccgaaccgaggtgtacaagattgagcctagagagaacctgacggatcttgaccgaaagtttgagccctccattctcaacacagccatgtatctgttgcagctggcttctcaactgtctaccattgctgtcaactaccagggccgacctttccgagagagcattcgagagaaccgacctctgtacttcggtcttctaggagttggtgcatttgcttttgcctgttctaccgagttcatgcccgagatcaacgagcagctgcagctggtgcacatgcccgatgtgttcaaggtgcagctcaccaccaccatggctcttgacctgggagtgtgttggttgattgagcttgtgctcaagcacttcttctcggattacaagcctagcgatgttgcccagcgacacgctaccgagattgacgatgatgttcgggagcccctgcccctggaggaaaagaaaaaccagtagagagtttagaataatgaattagatgtattttacagatatctgggtgtgccgtgtccctgtatagttgtggacggtgtaacatggaagtattggctacaaatgacgacttgtcttcatctggcgcataaggaaggtgtctcgaggggtgcacctactacaagtgccagtgattaaatatgtatgtacatactgtacatactgtatgtagctcttctttatctattaaaacattactgtaatacatagcatagtatatcgtataggtacagctagaatgggaagtagacacagccagcactccatgttcttagtgcccaccgcgggtagagatgactgaaggagctctgttacctgcactatagcactaacataagtatcatgaatctcctgagtctctggagtgacagttgggttatcatttttctcaacagcaacatcggaagtatgcactaagatatttgtgtccatggatgtgccttggacaagtcccttatcattccgctcctcaaagattccaatagtgtctgtggacaaagtccatgttggtatcaatgaaatctgtggtggtatcactgaaatcatcagggaaataatggtttgtgtggtgacgtatgcagttctcattgaaatgccagaagcacagtcgacatccatcgaatgtgtctgcctctactgacgattcagattttgttgcagccatgttcacgacagtggtatcaggatccaggggatcaaggatgcaggcggcaggcacatcaaaagcaccacctgaaatagctgaggactgcatatattttcagcggatcggaaatgtctaagaacttcgtctaacattcgtcttttgggatcatggatctcctctgtctctttcactcccaggtgacgcttcgtcagagaagttcgctctacaaggcagtcaaaaccccccttggaaaactcataccaggtaagtctgtcaatgcatctcttcgcctggtcttgaatatcgataataggtgagttggtggcggacatccgagtggtcgagctcttcgaagcttcgtcatctgggcagagggcagcgagcgtgtcatggcaactgattttctgtaagttgggaataattcatctatcttctgaaggcttccctctgtcacaatatgaacgagttccatatttaaacacaggtgaactagaaagttgcggatgatatggaccaccactttctccagaaagccgtatcctggtaggcgggcgaaatggggaacttcagtggtcttgactgcggtagtgctgctcatagtcatctgaatactctttttggagtggcgctgaggaagattgacgttaccttggatacaaggacctgagagatagagcgcacacctgtctaggctgtgtgtgcgtcgaagggcatgctgaccgcagctgtctttccagtataacaggaattgaagacagcaatctggatgggcagactggactgagaggaacatgcggttcctgtcaccggtattcgagctggaacggagatgttgggcgcatatggagctcttggagcaaaatggcccaagacaggaagccctggggcttcgttgggtaatctgggtatctcctcaaatctgctgttggggacagtccacattttgagtgcagacatggtgtatttatcggtcatgcagatttcagtaacctcaacaacccattcacctcttgaaacaccggaggggacgttacagtattaatttatgcatgcacgataaggacgaaattacctgtgtgcatgagctgagcagttgattctcacaacatggacttttccacccattgaaaatacatatacggggacatgcttacaataattatacagactacgccactgtaacattacagatgtagtattccaatattatataataaaccgtccttacctacaacctagccttgactcggtactttctcttcatctcgttgagaaagctccaattggtcagaattcgctgttggtcttcgggctcttccctgtcgaccacagtgatggactctcgtcgccacttttcgtacaccttgaacacgtttctggatgccgcggagatgaaggacagcagctggtacttttcactggtcttggaaacagactcgggggtgatgagcagacactggaacagtttagggtgcttctgggctgttttgaccatcatatcggagccctttccatcacctaacccaacaaacagcgtcttgttctgcagcagaggatgctgtctctctctcaatgcctgaatgaccatgtaggggtctttgtcgccaacatgctgggagtcaagagcaatcacgccgttgaggaaaagacggtgtttttgaagcatctcctgcttcaaagaccagaacaaattggcattgtcacggttaccatctccaatgtagaagagagttacccggctatgtttaccactgaccatgcctgttctaccttggtagagagacacggggatggaggagactgtcgtggtgcttttgaacattttctgtttcgttgatagtgacaaaaacacccaccaatttagtgccgtctcattatatatatataatccgcctttgcgcccttttagtgtttcagaaccccacatagaaagcggggatatgcacatacgctagctttgattaaatgtgggcgtggctccgttggacataatcttgcataatcgggtagtccaaaagttgtagtagtttttcttgactgttgttgtaagccattgattctctgatgtcgggtctgtagacgcgtatcatggttcctttaactcattaactgccacctacaagtagtggtcttctatttgtctgaaatattaatttggggggagggggctgaaaacgttaccccactattttgcacatcatacgactctgacgtcgctacaatatgtacagccttatacagtcataccagttagttactatacatacacacccacgttggaaatgtcatcgtgagctaaaggagtgagggtctcttaggagtcaaactcgtccagtctcaccttgcgtctaatcgttccctcctgattagcaatcaccacctgatctccctcgttaccaatccaaggaccgtccagacgggcagtcaggtggggattattgtaagtcaggaaacgctctcgagcctcatccagggtctgagaccgcatatgtcgcatggaccgctgaccctcgagatcagtgaagctgactccactgcctccagtatctctaatggcctgcaaggcaatgaactgcgtcaggggctggtagttgttctcaaagttgtacaacagcagcatggcgcatactggaagaggagctaacagagtggcaaggtagtaggcctgctgaagagccagaatacccgacatggtggcatggaagagcaccagaccaacgcagactcgacgcacaatcataggccaagcctgtccagtggaatgtgagggatggaccatggcgtacatgagcagatacttgtacgtgaagtaacccagaacgaagtaggcggttccagctgccagaatcttactggacatgacatcaaacacggagtaaagcagggtgatgatcagaatcagaatgggctggggaagattgagtccaaagttgaacacaggaggggtgtacagagatctaaattctctgggagtatgggtgatgggcttttcaaaaccaaaccgcagcaggtttccaaactcaagcaatctaaacgggaacatgccaataccctgaagaacaatcagatcaacgtagaacagagcccacttcttcaaagaagaagcaagcttgtaggcaatggaagtggtgtccttgaggtactggaaaatgtcaatggcggctccagcaactgtgaagataaggaacaggttgacaaagatgtaaaagaagttcttggaaatgacagacaactcctcgtctccatgggaaataaaaccctgcaaagaagcaaggtaaacgtaaaagtaggggagagcaaagttcaggattgtgaacaaatagggaggcagaataccggttaccagcttctccagccacggagtgtccttcagaagctgtcccagagcgggccacgacttggagatggtcttggtgtccataagcttggcgacacccaaaacgggtggtaccagggccacagtgaggaacccaatggcgattgtgaccgcgtaggttcgaacttctcgcttcatagtcgacatgtatatgttcttccagataatatcatgaggtgccggggccagttttgcaatgagatggtagggagaaggatctagaacagcctgcgccaccatctgggcagacgcaacactgtccatagttacaaaagccgtgttggtaggagtgtactccttgtgacgggccttgataatcttctgatccagagtgtcgagctggccagtgtagtaatcaatggcgtccaccttggtgccgtacagaccccagaaggtgaacccatgccatcctccaatacgcacggtgggtctgtcgtaagaatgagttcgagagccgagctgcagagtagctcggggtgtgttgagaggcgtgttttggccagtagaaactgaggagctcgaggaagaagggttgttggtgttactgggctcgtccaaaatgtgtccgttgttgctgggaagaatcgtaggcacaactccaatgacagtctctctatccacctcccgagggcccaggtatacacaccaggcaccctccaattttttgattatttcctttctcaccacaaatagctggtccaactctccccactctctgcaaattgtgatcgaccgcacatctccgatatccagcttttcaatgtgttctgtgagccggttttcgtctctgagctcggtggggataccagacagtctgatagttcggtctgtgatcgagttctgggctccgaggtatcgctgtcgcactcggatcactttttgcgtgtatctcatgaggaaaaaggacacgattccggtgaagacgtatgtgaagaagacataagtccacagatagggctggtagtcttcctggggcggtggcacctttggctttttgtcccccagcgggtcttcttcttcggtggcgtttccacttgctctgtaagttgtcactccaaatgaggtcaagatcagtctcagaagaatcactccaacgtctatacctgcctctccatcttcatctccgttgtcgtagttgcgcctgatcgggccaatcactgtgacggcaaaaaacgtgcacagcgcaaaaatgataatcgccatcttgaagaactgcaaaaaaacgtagcagtccagaccacaatgttccagcacctcttcttctgtgatcttgtagagcgctggaatccagccaaagtaagtattaggcagcggtggcaagccctttctgcgcagcgttcgggccgcgtaaatctgaggccaatttttccgtagaacacagaaactcagaaacgctgtcatgcccagagatccagcaatgagcagttgtgtcttgagcagcgagctgtgcttccacagatccgggccatcgtcgtccggctttttgaccaatactgattgccaggacatggcgtgctcagttgtgtatagttgtatcgtttggttggggggtttggtggtggtagtcaaaaagagtggtgatgttgctcaggagtacagtgcgagtacagcagctacaagtagtatgcatgataactttggacaaaccttaatttgcctttttccttggtttttcagaatcatgtgattgtatgtttgtagtgtgttcctgtcattctaagggattaaataaatgttttctgggtgtgattaggcttgtattttgtacctcgctcttttcggcttcgaaaatcgcgttgcaacaacgtgtcacactcttcccaccttcccacttgcaatataaactccccctattctcacaagcctattggactggccaaccatgagatttgaggctggaaagttgcagtaacgaaactacctgctgttccttcacttgtatattcgtttccccgaggaattttctcagacacccatcaatagccccaagacagcccccaaaatatactctgtctcattgtccactcgttatcgataacaatgaacaatgatgctgcattaatatacctttcagaagtgcggtaaactccgatgacctgttaccctacattgacatggtacttttacgaaatgacttgcgagacaaaatgaggagaccgctgggggaatatcgtctcatctgtttatctcagctgttatgttgttgtttttattctaatggggtgtaagaaaaacgcaccctctaaggcacaagggatggacaaattagcgctgcacgtcgacgtggtgtagaaccgccgataaggcctgattgcgtctacacgtgggttcgattttggttgtgacgcattaagaaactgcaaattgattgtgtgaaatattccctctggtactaatacgctttctggtaccacgtatccaatatactgtaagtacgacgtaggccgaaatggtcgcgccgtgtgcataacatctactgtaattctagaatacctctcccctcggcttacctaatatatatatacacctgttacttttatatagacacactgataccatcggctgtgtcaaacccccaattgctcctctctaaatggcaatctccttctttgctcgaggctgcttacctcgtccatatccctcctttccatagtaatccatggggtagtcgttaccctctaaagtgtcctcgtccatcataaccatcgcctcgtagggagtcagcagaggtttagggaatgcgtagccccaatcaatagaaagacgggggcacgcaacctgcacccacgcgtcaacaccgtcgaataaggccagcttagctgggaagatctcactcagaagaacaatgtgtgtctcatagcccttagagttgagcttctcctgcagcatatccagagtagcagtgtttccctgtcgtcccagggtccccagaatgagtcctatggtcttggcgttcttggctgtctggatggcgcgttttcgcacgctgaccatctcaacctggtcaaagtactccctagtgagctttcttgagtagggatcgtatctgtatgcaggtatgtcggggttgtggatcatggctgactcgagatggaaccttccgtctccgatgtacataatcatatcgtaatcttcagtagacatgtttgcagaagtgcatcccagaacctcacctttcgacagaggcatgatctgaggagcagtgcatacgattccagcttcgtttaggagtcgatccttgagtgtgtggatggtagggttgaactggatggttcccaccatggccatgcgagttccagtctcgaaattcttcttgaacgacttaacgacatggtcagtatcaatctcgatggtgacaaagacataaaggaccttgattttgatggagtcgatgggaaccagacaggagtgtgcataatgaatcaggaagtcacatcccagggcgatagctgagaagtcatcaacgcagcatgcaccataagtcacatctcccatgacaactgtactaatatcgggtccacagaactgctcaataatatcggaaatgatgcaggcgtaaatgagaagaccctcgggcatctgaagggcaatcttcttgcagttgttctttcggatgtgccaaatactcttgtggatctcaaagttgtagtttttgggcagcgtcgttgcaatcacttcattgagctcctcatcgttcagaatctcgtcgggaatctggttaatgattcgtggacgtctggtagtgttcttgacgagagaagtggatgcagagggccctgagccgttagcacggcccacaaaacgctttcggggctgtgtggaagttgattttttgcatgtatcggggtcacagggagctaccggggtggcagtcgtactcttacactcaccagatgctgaacacgacatttctgagggattcgatgataagttacacagggacgattttatgcatgctgaaaatttatttaggttgggtgattagggatgcattgctgggaatcgaacccactacaggttgtttctgccgaaattgctttctacggatttgatgagcaaggcttttgaagcagatcgctacgtttatctgagtcatgaagtcgttggagtgattttaggaccgcctcgtgtcttaggtgctcttttcaccgacttctctaccccagtggcaaaattaaactttgctttctgacgaggcttggactgtctgaggcgtgctctaaacaaagttacgatgatatgcaagagatgcataaaaataattttttgtttcctcttcatcaaggcggcacacaatgatcactcccgactttactgtggatcaggacgaggactttgtgttcgtgaacatcaaggcaccccatattcgtgtcgccaacatcgagattgtggtggatggcgagctcttcgtgttctcgttagcaccctattatctgcggttgcgatttcctggtcgacttttggacgaagatgaggaggaggtagagatggtaaagaagcagatcagcgatgccaatctcgataaaaaaacattgggtccaggtgatccgaaatcagacgacaattcgaccgacaagaaggaggctactctgattgaagaggtgtcgaccaagcctctgatagaagagatcacagagactaagaaggaatcggaacctaacgccaagaagcgaaactacgacgagatggccacgtcgactttggtggaagaggttcggcccagcaagtttcttctggaagagaacacctctcagcctctagttgaggaggtggagcaggtcaaggtcaagcctctggttgaggaagttggcggtggagggctgctaattgaggacatcaccgagaagacggacggcgacgaggctgtcactaaaatcgacatcaagaggcgtccaaaggtgaccaaggctactgctacatacgatctgggaagctctaccatcaaatgtcgaatccccaaggaggaatctggtatgtggaaggacattgatatgattggaaagcttctggctcgtcagaatgagacccaagtgatggacgatcttcgaaaaactgtcattgaggagctggatggaaatgacaacgagactgagcctacagagctccaggaggctgatgcatttgactgggagatcaaacaggaaatcccgaagctgggtgaagacagccacgttcgatacggctggcagggaggatacaacggtgctgtgggtgtcagtgtggctaagggtaacgatgttaacgagatcgttgatcctgagatgaacggagtcgacgaggaggctagaaaggagctgagaacagacattgaacagtcacgttttaacccaggctactatctatccgatctgcttgagaacgatatggttcccgagtatcttcattacgagcttcctaaggaattttggaaagagaacaagagcgacatgttattgtcaggcgaagagaatcgtgttctgagcgagattatgtcaaaatctcggtcgaaatcagcgtacaagaacatttccgatcctaaaaaggcctacattggactgttaaaccttctgttctccttcttttacgacattcgaaccacattcaacgatcatactgtcgaatccccatggacgattggtaagttgactcctcagtttgcctctttggatgattctttctacaccgtctctgaagctgtgattgcgagcagtagacgtgcgctcacgtatcccctggtgcgaagtttcggactggttcttgagatctggaaggatgtttccaaggtgatcaagtctggcaagcgggctattctcaaggtgcttctggagctgtacaagctcttctcagtgcacgacctctattatgtttatgctgacatctggcttaaggactacattggatggatccagtatgccagcgacaaggtgttggattcgctggccgaggagttggacaagtttgttttgacgaaggagatgcttgggtttgatttggaggagtgggagcggaaggctgaagagggcgaaattgagcctgaaacaggtgagtctgaagagcagcagcggtagatacttgctcctaatagaaggaagggttatagatggaaagaaataataacattatacaatgcaggatgcccaatcggtcgatacgatatttatatattcttctgcagtactgtagtttggttatgccaaggtcgcaactgataatcgcagcccctccctaaatcgtatttttggaactcgcaattttaatcgtaatttggaaagttgtaattcgactttgataacgagactctaaactgaatttgtaccccttgctgcttctgtgcgtttgttagtaatccgtctcgagatatatgatcgggcgacaagaccaacggccatggcttgttagcatcattttctaatgtcgtacatggataatgcaagattatgtaagaccacatatgatggatggcgtgccgagcgcttcctcggtggaatcggcccattttctttttcgcgataccgctcacatttccaatccctcgccaatgacaactggggtggttctaacgttttttgccatgtccaaaacaccttatttaaatacctgcttaattggctgaatgccgtcccgtatgtacccaaatacctcaactatgggaggttggcagaagttcacgcaggtttgcgatcagcaacattggctcccgttgccatctgctcatctcgtttgccattttcgctcactccagtattaactgccgactctggggtgagaccaaatgagacattttatgtgaacaaaaggaaacacagccttgtctaagggagtgcgtgcatggctaagttgagttaagtgctgaatttagcaagccttggggaagttagacggatttgtatggggtggtattgcaatatctggactttattgaccgcaattgtggctgttgtggccgccttggtgtcctaatccatctttcaatggcttggcttgctatctcactggctacgcccatattttgtgttttccatttgtcatataagagagacttttggttgcgcagatccggctccgcaaaaggcagtttaatttcatacggttcacgtgaccgctgccagagttcgtcattaacacaaatggtgcatcgccgttgtttcagtggtgttacactggatcatggtgatgatatggcggggctatacaacaaaagacggtaaaagtggagagagagttggatttgccatacgacttgacatcatctgtccaaactggcaaccaaaatttcaacctaagatctgcgatactgaaggagttataacatccctatcgctatcccactatacttgatctctccaactaaaacccaactgtggccgaatgcagtagagttctccattgaacctctaattctaacccaatattttgccctaactttggcagagtttgcgcaataaaaacctatagatgccgaaagaggtactttaagagtctgctcgtgcacttgcgggcggtcttagcgaatgcttgtgcgacccaattatggaggggtttgttttgtgattttgagcatcgaaatacacctttttttccatcttgtagccgcaacagatcgtctgaaattgatgctgatcttcagagcgatgaacaaatgaagatcgattgacgacgggtacagagatgacaattgcggtagactaaccagttgcagtttgtttgtcaccatattaggcaatctactaaccaattaatcttagtctatgctgtcaactattacttagcttccacgcccaactaatgatctcttctatgtttacccatccacgtctgtacacttcgccaattactcaattaacacctgtgtcccgataatttacggtgtctgccacttctacaactagaacatctcctaggatctctctcaaacaaccaattgacctctacacctgcttcctacacttactggtggtatctctccacccctctaacctcctctccctcttgggtattcaatatattcgcaccactcgcacacggctcgtgggcatgcattacttctccttgtcaatcataaaatccacgccatgtttgtggctttttgcctgggggttgggcgtggttctttcggacgaaacagcgtccgttttgtaagggtattccgggatactcaacgacgacagctcgctgccagttcctccagccgtaccgccgccgccactctggaagtagtttaatgagcggttgaaggaatcgctccggattgatgtttccgagcgatgtcgcgtgtgtgtttttcggcgattggaaagagatgctgcgttggcaatggccgtggtagatgaagatgaggctgattcagcggcgtctgcattactggacgcatcactaccccgacttccccgagcagaccgctcggctccacgctgctctctttccctctctctctccttctctctctccctctctcgttctcgttctcgttcgggggccgtggcttcagctcgggcagatgcgcctgctgcgtcacttcggcgtcgctttcgacctcctccgctttcctcctcatcgtctctttcgcgatctttatccttgcgatctcctccccgtctttctctctcctgtttctccttctgctccttttccttcttggtgttagacggcgtacgcgtcggctgccagtggtggaactggatgatgtgatgcatggattgagacggtggagcgaccggctgtggcgaagatggaggcgatccagcggcggctccactaggtgtgcctggcatgccagaaggagcacctgggggtcccacaggagttccaacgacgccaggagtacctgctccgggtgtacctgccgctacaccaggagcatagtacggccagggtccgacagggcctctaacgggagaggtatgcgttgcggcctgggcgtggggcgagttggagtatatgggcggggacgggtgcagttgtggctgcggcggctgctgcatgtgctgcatgggatgcaccggaccaaactggaagcgtcggggcgattgggagccgtaatcagtgggcttagacggcatgctgaggttgcgctggtgatggcggaaggacatacgcgagtccttgtgcagcggagacataaggcgagctgattcgtggggcggctgttgttgctgttgttgtctctgtggagttccgggaaccactccctgcgcagcggcagcggcgattgcgcctgcctgcgcagatatagacacgccgggagtaccgctgtggctgggggtcgagtgagtggaagggtatgtattggggggcgcttgagcggccacaggaatagaggctgactgggtaagcacgtttgctgctgcggcggcggcggcctggacgagagccgagtatgaggtcagcgacatgggcgcatcctgggcaagtttgtcaagctcagtcgttatgtgggtcgaggcggaggctgcatcgttttgcgtaaacagaaggggtatcagtgctggggggacgttgtactttacggcctggtcgaatagttgcagcgagcgttgggcgcgttccatgcggtagtattcggtgcgcgacagctcctgctgcagtaacagcgccgccgagggagcttcgggagctggagccgctgctgggcctcctgctgggcctcctgctggtgctgcggtggtggcggaggaagagtcacccggcatgtgtggtgggtggagttgtgaagacgttggcgatggtggatgggtcggttcgggctttacatctgaggtggccgcggaggatggcgtggcggacgtggccgtgggtgtagtggctgtagtagcggtcgcacttagtgcacttggtggggctagagacggagcactcgttgtggttggctggtcggaggcgacgctggatgctggcccgctggcttctgctgatcgtgccccttgacgcgctgaccagtcggacatctgaaacacatgtggctcgtccacggtagctgccatagatgcgaagaaatgttagtgagtgtctagttgcaacaagggcagcaacgttctagagtgcgacgggatgctgcacgctgaggctgtgcaacttttccaagggatgctgagtgagaggcggtcgagcggacggggagggtggcgacaacgactgtgtgggatggcggcggggtggtgcaattctgctggcactctctctcaaagtcaggctcttcgtttccgtataggtcggcttttttttctcttccacccaaacttttgtgcacaataggaattgataaacctctgccttggctcacctttgtttaaactaaaaagcccaaactgtcacgtggaatcagctggcctttctgcattgagatgtggggtgcaaggacaggaacagcaaatactacagagcggagcaacaggcagagggagccagccgactttgcgggcgccgtcacgcgagctccgccttggcacagatttcccaccggtccccaccgtcacctaccctccatgtatacatccagcactatagcataccagatgctgattagcttcgttcaatgcagagtagtcaaagaccaagggacaagtagacgggatttagagaaaacgaaaaaaggggaactgtgaaccatcgcccactaataccgccaaatagactcgccagccggactaaataggcctggatagaccgcaccaaaagtcacagatcaaaattacttcatttctctcaaacacaaacagttgcttatatcttgttgtgccgtgggcactgtatcttgtgtgagccctatatcaaaccacaatctatagaaacaccaaaatgcactgcagcagactgctcatttaacctcaactcccaaatcgatcttgtacatgttgctttatgagtgagtgcgaacaccaagtggcaaaaaatcgtacgtctcagagatggccggggaggggcgtaggatacatgacgtggattcgcgtgtattcgcaaggtcccccttgagagagccaagtctggttgccatagtaactatcgagtattgtcttttaaaaccgctgtcttggggtgtaagaatctgaaggccaaaatgaaggttccaatttagatttaaactctattccttatagagtgtaaacgtggcaaaattgggcaagcgcatggaagcttaggctccaaacaggagtcgagtgcccgttttaggagtcaacatagggttcgagcttagacttctccaactatggattatgtaagcagttgctggggaaacggggtgggaaggaccatttggttttggattcagaggtttatcaagcagggtaggcaatctgcgttttagtgtcactttgatttgtcataatataccggggcacgatacgtcaggttggtgtggaatgtggcgtagacgtttgtttgttgttttttcgacccaaaaaatatccctggaaaatattttgggcggggggtgtcggccaaaagtgccctttccatccaaggcttcacttctctgctccttctctttttttcactccagccttatgctgtgtgtgcatatattgaaagtaaaactgtgagacggggcaacctgctcacgtgattcgaaatgcgcaaaatatgattggattggttccgtgcgatcgacagtagttaacggcggttggttaaagtcggttccccgggcttcctttgctttactcttattgccctgatacgcaatgggttacagggacagacatggatgagcggcagggttctataaataggaaagtatcggaactctgcgttcagacacacgtaaatgagaggtttgcaaagttgcaggctgaagggttttctcggtttagcttacatttcgcttcaagacgtatgattctcacgtgtagggcggtggagcaaagagcaccatgttctagaaaggcaaggaaccagcacgcagttgaacccatctttggttgttttacgagattgagtcgttcttcttcctcaaaagtcctatctaaagcctagtcttctcccctcaaacgtacaagaactagcagtacgaggccctgatcttgaattattaaatccgggccgtgaaagctgtgcagtattagtaccctcgcacgagggtgtctgtaaaagttgcagtctgattggggacagcaccaacaaaaagaaacaaggtcctaatataacagggtgatcctctcggacgtaatctgagccccacagctatccctttccaactttcaaagggatagcctcggtatttacttattgaacgaattagcagacttcggccgggtggtccacatgacctatactacgggtctcacactgattttcttctccgaggtagttgtcaattgaattcctcgtctctctatttatatctctagagttcacataccggcttctgctatcatacatactgcgtaattacatcgaattcatgcagcccttaatattccccgggccatgaaaagtttggtatattatgtcagacctgccttcaaatattacactggaactactagtactgtaccgcacaatgcgcaaacatagtctctttcgccagacgtgccccctagaactacccaatccaggaatattggacttattctgggcttgttgctctcttttttttatagcacaaccctagcgataaagaaccccctacggaaggaaaagggaaccaaagatccgccaaatatgtaacccccagcattttagatagctcgtatacccctgtggattgcacctttagttcgtggtgaatgtctctgacacactaaccatatttgcctatcgaacctagttttgggaggtgagcgggcatgcacacatgttcactagtgcatgaaatatgcaccatcaggtgataatgtcccgacctgtcatggcggattgagcatccaaacaaacaaacaatggagtgatcgaggttgatggcataatctaggttatttttatgtcgaatttagtctgttatgccactgaatagttttacgtcttctttttttctttgcaaaatgtatctgtgctgtttttaattaacgaattagtgttcaatcacagtatgtacgtagtgggggggttcatatgtgccgtctgtacgatacaacaccttagcgtaaaacatctttgtgtgctgcaacatcatggtctgctcttgttgttatattgaatgtatcttgagttgagtacgagaaatacgacgtccagtcgtatgcgacacagttgggtctcagacggcactattggccggtccaaaatagcgggtagacgcgccagtagcttccgtttgggaggcaggagtcgagaattacgatattatattattttccagccgtagccttctccagtagaagtcttggcgttttagaccaggtgtagcgtgaccgaagccacgatctactcgagagttctacttcttctgcgcaacctgtctgcacagttagctctcccttctgtgggagtacgagacatggtagccccggcaatgacatgctaaggtggatctgagacatccttatttggatcagctgttcatactgtaattgtcaatgtgctcgcttttggagcgttattattgactctacggagtcttgtccagaatactatggtgttcaccttggctcaacttgcagcggtattggtggtgggatacgttccaaaaaggagataatttttcttagtgatgtagttattactggatacgtctgatccctacacctgttttaccttgggagacttgccgtgcgtgtcatctcttcgtattctttggtgtccgtaaaatctggtgcatccgctggcttgtgctccaaatacgtgttgcgagccgcagtgccatatatcgaaagaagaaaaggaatagatttattaatacttttttaattacggatgtgatagcatgtctttgcacaattcgtccttttaaaaaggcggatgacagagattatcgtggaaggatgttggtcaaacgtacatactgtagctccaattgttgtatattacccttctaaacattttgatctgctaatctttatgaccattggttgttctcaagtatttttacaataaatcccatagcaatcataaatgcaccagccatcttcactgttcacccctttgcacctcaaagatatctgtcaagtagctcctcaacactactgtcaacaaatacatagagttacttaacttgagtgtaaagcataacgtcccccagatactagacttattccggatgcaactggctcacaaaatttggcataactcgttgagcctttctctattcacttatcagctcttcattcttccagatcatctttcatacatgttccacgctatatcccaaacatgcccacccaacaacgatccttaaccgattattcttcctagacatgacccttcaggtccctcaattgcaccccaaaatgtctgaaagtcggcacatggacattatcgcatactttaactacaacaaactaccttctaccctcccagccctttccaaatcacatctacaaggccccgaaaaagctccgccgaaaaaacgccgctcaaaggtcggctttcggttaagctccatgcactccacatttcaactttatctggagtaaagagatatatagccagagtgttttatcctacttagtacggtacccataaccactatcaacatcacgtcacacacacacaattcacaatgctccgaacaatctccagaacccggaccatggtccccagccgacatttgatctcatacagattcttctccgacgtgtccacgaccaagggagagacgttcactctgaccaaacactttttggatgcctccaataccgcccacattgccgtctactcgctcaaccggcccgaggccatgaactccatctccaagaagcttctggaggaatttgagacctacatcaactcgctggcagccgaaggacgtcatcagaatgtcaccaacactcgtgctctgattctgagctcggagctgcccaaggttttctgtgctggagcagatctcaaggagcgaaagacatttactgatgctgacaccgctgccttccttaacaagctcaatggcactctcgacaccatccagagcctgcacatgcccactatcactgccattcagggctttgccctcggaggaggcgctgagatctccctggccacagacttccgagttctgtctgatgtggcccaatttggtctgcccgagacccgtttggcaatcttgcctggcgctggaggaaccaagcgactccccaagctgattggatactctcgagctcttgatctggtgctcactggacgacgagtaaaggccgacgaggctctccatcttggtattgccaaccgaaccggcgagaacgccctcgagactgcccttgaaatggctaagctcatctgtgagggaggacccattgcgatcaatgcggcaaagatggctgttcgaggccagtccaaggagtgggagatcgccgcctacaacaaggtggtcaattcggaagacaagttcgaggctctgtcggcattcaaggaaaagcgaaagcccattttcaagggtcgataagaagtagacaaacgagtgatgatgagtgagacgatgagtgagatggcgagtcgaatgatgaactcgaagtaaaaatgactatatatgatttaatttggagagtcggtagtggtactcggcggtggtacttctagatatcggaacaattaacatcagttggtgatcaatccatacatactacaagaaaaaggggttgatgtacaacagctacccaacacttagggtatcaagcccgttcactagaatacgtcacatacagaaatcataaaatgactatattggaagtcttacagtatgtactatatgggtacaagtacagtatgtactgcttcatttgataaactgatctacaaatacagaggtgacgtttatttttgtcttctcctattaatagttggtatgaccatatacttactgacacttttcttgttgactattgttcagctgaagtcccaagtaatatccgacctagcccctcacgtctagctgaaacttattaaaccactcaacaaacagcatcttccatatcagcagcaagaataatggaaatatcatcatcatgacgaatttaggtaaagagcaaatatacaaaaactgttatactgctcttttttcatccaactaagaatttcatatatactgtaccttgtccttccacgcacctcctacagccccttatgatgagtaagcagattagggttaccctcttcctgccatgtatcttctcctccctcccatataaatacggattacagcaacatgagtacccctccttattacaacatctaccgggtcagcaggtgagtttagcagagttattggatgggacaggcccgagatgaatactatgtcttttccagcttcattccttgctatttgactgatttttcatgacatgttgcgaggtccggcagtgcagtcatggatacctaaggacaatagagggaacggcagtgacgatgtcacagtcatgacactacttattccatcctatacgatatgtccacccggtaaccaccacagaccccggctatactaacgcagcataggaacagctctcacggaggccctggatgagctgattcgagatagcacgatcccgccacagctggcgcttaaggtggtggaggtgtttgaccgggtcatggccgacactctgcgaaatgatgtgcgcaatcgaatgtccttcaagggcgaattgcatacctaccgagggctggaggacgtgtggacgttcatcatccgacgggtggtgttcaagatggacaacaatgacgtggtcaacgccgacaagatcaagattgttacctgtaatgcccggaaggccggtgatgcgtaagtgtcaccgtttaccaagcgttctcatgacgttgtcttttttgtgccatgagaatgctcaagcggtcagagtgaaggacatgcagaccaggcacacaaacccctggcatttgtttctttgcgtctaacgtctgatgtccgttcagagtgattctcctctatatagtaccccacttgattctgcactttgagtaaaagttctcggtgcaagagataatatatgtttggttttatcagagctctaaagagagcgatacaagttgattgattgagtgttattagatacagtctgtactgtagttattggacagtatgtacagtatgtacagtagctgctggttcagggaccatactgattcgttccgtagagttgcctaatcaaggctgcactgtacatactggacttgtatgtctcagtggctggaagagtgtctgtctctagaggaccactcacccagcctcaattctctacaagtactgtgtttattgtagtgtagatagacactcgtagtaacgccgcatgtttatgtaatcaggtcatccaaggaagttcctatgttgtcataattaagtcaacaaggcggcagaagacattactcaagtacacagtatgtacagtatcgagcaagtgccggtacagtactgtacgtagcatgctcacaaacatttttttatcagttcagtgtatacagtgtacaatccttcgttcacattttgtcatatttcgttaaagtacagaaaattaaatacaggtgacccatttctaaataaccatggatcggtagtgaggctgcgtctggccttggggtccgccgggaggtccctgaggaggccgtccctggccctgctgaccaggaggcccaccagggcctcgaggacccatcatatgaggtggaggtccgccctgatgaccaggaggaggtcctccaaagttctgctgctgtccaggaggaatggcagatcgaggctgaggtcgatgaatgcctccaggaggtccaccaggtccaccaggaccaggaccaggaccataagcgccaggacccccaggtccaccagggccgccatgtcgaggaggctggggagccccttggtaaccctgagggggaggaccttgctggaattggccggggggaccttgaggtcgtccctgaggaggtccctggtgtccctgaggaggtccctggtgtccctgagggggtccctgaggtcttccctggttgggagggccgccaggtccaccgaaaccgttaggaggagggccgccaggtccaccgaaaccgttaggaggaggacctcggaagttgccagcgggcgaatgggatcgctggggctggacagccggcatctggggagaagaaggtcggccctgttgctgagcgtagggagcagaggggccatagtttcgaccgggatggccctggccgtgggcaccaccctgagggccgccataaggtcgttcctggggctgctgtcgaggaggaggctgctgtcgcgcaaactgggagccgggattgccagcctgaggaccgggacctgcgtttccggcaggagggccctgaggagcaccgttagcacccattccctgtcgctggaagccgtggggaggaggttggggactgttaccattctgagcaggtcctcgggaccgctgagagaagccagaagaagaggagttgttggccacggagtacatggagttgttgttagcattctggccgctgggtacgccattgggtgcggcctggacggtgggagtcttaggctgggtggcgttggtctggatggacagcttgctcatgtcctcagtagggtctcgagtgccgaaaatggactctcggatatcagctcgggtgtcgcctcgagaaacatctcggatgtcaccccgagagcccttgtggttgaggttggggccatcaacggctcgtccgtagctgtcctcatccataaacgcaccagaagtggggtatgggagttggggcgacttagggtcggtggacttgccaatggagggcagcagggtgttgggcttggctccgtcgcttacgtgacgctcgtgagttcgaggcacctgcagagaagcaccgccagtgggagccttcggtagagggtggccattgtcctcggggactggtccaaacgtcatgttgggatcccgctggggaatctcccgtcgcgggggctcccgcaaatgttcacgtgaccttgccggagagttgggctgcgacacagaacggtccttgccgaacacattgggagggatggccaaggacggcgagttgcctccagatccgataccggagccgatagaggagactcgtcgggaggcgagaccgccagagcccttgtagccagtggacatctttcgagacagaatctccttaatgtttttggtccacatggcaggagaccaggactcggatccagagacaccgacgagcatgagaatgtcagcgagctcaagataattgacgcggggaagtgtgggcataccaaacagaagcgaccgctggtcggtcttatcggcgttaagacggacaggtcgaccatagagcttgaaagcatcaaatacagggacaaggaatcggatcagggtctcaaaaccaagcacaccggcatgctgctcgggcataaggaacacagaagcgtccttagcaccctcaacgtcgtcaaaggtaacagttccatcaatcttgaacagcgtcgagttgttgataagcatgggagacgaggggtagatggcgtaagcggactgagcgactgtgatcttggcaagcggtggcttcttgaccttcttcttgtcttcgtaaaaggatacagtgccgtaagcctcatagcccttcttcttggccttagacttgaccttggggtcgacgggagccacaatggtccagcatcgtttccaaggcatgccagggccaaatcgcacagacacccagtcttcgtgagcgaaccgggtctcagccaaaagagttcggataccgttgagctgtcggcccttggcagaaagaagaccaccagtgtaggcctcctggagagaggaatactcaaattgcgacagtctgagggcagaagaccactcctgcagcagcttctgggacgaaaactgcagcaggtatctgtttttcagcgttgtggaaagcacaataatgttttgcaggtctccgttgggagaagggagcgtcaagatggacttgaacgtggcgtcggtgacgttgatgtatgagggcttgagctttgcgaggccgtccttgtgtctatcgagctcttcggcgtcccagatggacatgacggttccctggagtctgccgtagacctctacccattttcgatcgttgactggttttccatctgtgttagtgtgcactaattcaagaatacagaacaagccacgttagtgcggggaaaagactgagagatattgtggcataaatattatgaggtatttaccaccaccatccgtgtctcgacgacgacttgagatgtgtttggacacacggcgattatcacacacggcgattatcacacggcgatatcgcgaaccttaagagattaaatgcaaacaaacaaaacgattgcatgcaaaagttgggatgacaaaaagtgcgtaatgaggtatcgcaatgaggccgaaatagaggactggaatagtcatcgtggagtagctattgtagaaagaccaccgtggtatccctctctgtatctcatcaggccttgttccttgttccttctccgtcttcaatactcacccttgttcaaatcatttaacagcatgtagtagccctcgaaataaacccgttccttctgggccgccaggagcgtgagaatggggatcatctctgggggcgtatccttgtcgagttctagccccagagaggctgctgacccgcttcgaacccgaccctgaggcgagctcggcgaagacgaccggctgttttgaacctgggccatcatgggggttcttgggcccgagttgtaggaccccaacgagctattgctatccatggtgctctttttgtgtcggtttaggaggcttttgtgtgctgtgttgtggggtgtaagagggtgaggtgtttgtctgtggtgtcactgtgcggtcgtgtgttatgacacttgtgagatgtgtgcgctgtgcttgtggcgggtacagtagcgtcagtgtagtgtgtcgtggagacaaaagttcggtgttcagcgagagatgggggtcaagtcaggccgctgtttatctaaaaagcttgcaaggctgtgcaagctaagacaggcggttagaagaatagttgaagttgcactttggtcagggtcagaccgcagatcgatgcagatagtgttgatgtaaacggaaggcgcaagtgaggctaaatatgcaatcgtcccagacaaggggtggttctgtctaaagatagcagtaacgctgtttattagcttcccagcgttacagagtgagcgaggatgatgtggtagcgttatgtgggtactgcgtgtggcagatatccttctgtagtttgtgtgtgtgtggatattgtctccgtctttggaggctgtcattacacactcattctcccactgttatgttcgacactgttatggtgccaaggttcggtgcttaaaatagacagccaagacggcattacaaagaccgaggtggttatgcggactggcgacgtcatagacgagcaaattcgtcgggaaatgggcgaagatgcggggtccggccgttatttttgttggccatcccgtccacgacagtcagcctcgacccccacgggcgatcacaacagggtgtgaaaaatcgcgtgcccaacccaaaagtaaaaccatggggctgagttcggttccgacccgatgcaaacgacgtcacatgaccacccacgagggtaacatgagggagtgcacgagataacatgtgcattcggagcaaatatatagccgaggcgacgttattaaatgaacatggacaggctgttaggcaaagacatggtacaaaccggaacactacggtatgtacggaaccattacataccgtctgccgcttgccccactgattgctcagtgcaactctcccactcgatcctgtcgacaaagaagaagagagcatagactctggccgttgaaacagggctgtgctagatcagatacgatgagagcggagcccaagaatgcacatatagctctggcggggtacagacagccaatagtttggggtctgagcactcggcgacggatgtgctcttcatacaccttgcttgcgtgtaaccagccgtaaactcttgatagctatatgcttttctggccaactgttggcaaggacagaagtgagcataatacccgtaagtgtgaagaaaatacagaccaacccacgatgtatcgtccacactattgggactgtatgtaccggtgcttgcaatagcgaacgggatgaatactcgtacgtatagcaacagcaaaaagaaaaagtctgtgaattcaccagccaccaaccccatccggccttgtttcaaagaaagaacacacgcacaagtacgtacagtaatagcaactcgctggtgcttgatgaagcaaccagcaatagttaatacttgacagcaagaacgggcacaagtagcaagtcttggagggtggagccgtataaaataacatggcgccttaatcgcggaccttggcactctcctcgtccactgtccactgtcaatctccgggcaaccccgcttggcaaaaaaagaaaaatatggaggtataaaactcagcctcgtttgatgtaagggctctcgctcgtatcatgctcaccatttgggtgggtctttggcacctacgcattttagaattcagagtagtttggaagacaagtagagcaaaaggacatgtggaggtgctggaggggcggtggtgggttgagagtaaaaggaagggaagagttcaccatttgcagttccttcgcgtataaaatttcagccgtctccaaagtcgaccagcgcttaatttaatgtctgaaagtacatatttgtcaaccctaaaaatctcacgaatttttagactgcacgatatgacggttgacgtggaaacaggtactcatactcgtacagttccgtgataggtatatttagacatcatttgattgtgtaagctgttctggcttcagtgagcggttagtcagccttttggttcttaactaagttgtctgtgttgagagaaaaaaattgaacttttatataacaaatacattaacgacgacttacctatcacttgctgggaagcgttccgataaaccagactcttctctctacagtaacagagagactcatcaggagagtctccgcaccctcgtggaggattcgactgagcacgccctcaggttgacaaattcagctgagtgagtgaattgcccctcagaatggaaactactggtttgtcacccacgtcacggttttccattcaacagtctgtacttgaggttcagcgacgtgccgatatgattataattatcaatgaagctgtgggttgatcttgctaaatggttcatttaattatcaacagtcgcttccaacaataggcctggtgcttctctacaaaactaacagtagatgctactgttagctgatcccagttaccagatgtactttacaccaatcaactcattcagctctacactcatatacgcttcttccactttagctaatattattgacagaggcagtctcgaaattaatagtgacttaattcgccattctcgaacgcatgcttttagcaaccctggaactcgggacaacggaaacaggttcgaaacgctctggatcaaaattgagactccaaaatcacatgttcaagtgtgccacatcacccatggtcacgtgggatagcaacgcttgctaaagtaggtacatgaatatgccgtatgcctacatgaccatgcgtatctcatctcggttgctaactctatctaccgaggttatcgaggtgaaatgggatctttcaaggatagtaatcgctgttgggacttaaataacgacttaacccctcacaattgattcattatttcagcttacagaggtccatttcccagtttcgagccaattgtgtgctgctgcctcgtatgtctgtatgcagcagcaaccaactaaagcaaagctcgagctatttgaactatacctgtggagtgagagtatatatagtgtgtctcggtggccaattaatcgtctccaacttacaaacacaaatacacaatgcttcgaaccactctaagaacttctcgagttctgtctgcccgacagttcaccgttgcctctcgtcttcagcaggatcctctcaagaaggctgccagcgatgcttacgacactgtcaacaaggctgctctgaagggaattgatctggctcaggatgccgctgatgctaccaagaaggctgctgaccaggccaagtccaagcttgattctaaccaactcgacgggaagattaaggaggtttgggagtctgccaagggcaaggctcaggatcttcagtctgaggctgaggacaaggcccacgatctcaagggcaaggtcgataaccagtctggaggactcaagggagaggccaaggaggcctggggtgatgccaagggcaaggtcgaagaactcaagggccaggcccagggtaaggctcaggagctcaagggagaagctaaggacgccatcaacagcggtaacactggtgatctgaagggcaaggccaaggaagcttggggagatgccaagggtaaggcccacgaggttgctggcgaggctaagggcaaggcccacgaggttgctggagacgccaagaatgctgccaacagcggaaacgctggagagctccagggtaaggctaaggaggcctggggtgaggcaaagggtgatgccaaggatcttgccggtaaggccaagggtaaggccgaggagctcaagggcgacattaagggtaaggcaaaggagcatctttagatgtcattcctttcaaaaagatgacatctgaataggatttctagcagttatatattataggaatgatggatattgaattagaaaagtagaaagttgaggagttagcatctagtagatcattacagtacctctagcttttcttcaatagcggtgttcttcgttccagatgtagaagctgttaatattgaacaattttgctctgtctgtttcttttgataaactgacattgaaccatggtatattccaggtagaatgataactgtctaggctcacttgaggctgtgtcgacctctgcgtagctacactgactggtcccgaggtgtacaagtacaatgtctatggaactaatgtagtcaagtttgtatcaaattgacggtttttgtgtgaaaaatgaatttgaatacacaaacccttggttacagtagcactttccctgacaggctctggggctttactgtacttactgtacagacagcagttcatccgtacattcagaagtagcttggaccggacttactacaaaactgctgttcggactacaaatttcttatgaattatcaaaaacatggtatgttaggaatgctaaatacctactcacgattgaaaacatttggacattccgcgatatggacattctgcgatattgtcactcttgtacatagttgtgataaggtggtggggtgcacaatcgaagctcagtctcacgagtacggcacggtgtacttgtacttttggtagcgcttttaatccaataacgcccccgtaggggactgttgaactccccagtagtttttgtatccgtttatacaacttccgtgcggctactcgagtggcacctgctcctgcgtcaaggggatcctctgaggcctgaagattttcggttggcaggatccactttatgtcactttatgtatgcacttgtgagacgagctgtctattagccacttcgaacgttggattctatttgtagtagttcgcctgcacaacaagtatccaccaagccctggttgcttctgctgtcatcacaacccctggtctcacaaacaggctacttgtagcggtgtgtctgtggcttttttattgtatttgggttgcctgattgccgcatatgtcatagtaatatcttttgagacagcggcagtagatatttccgtctacccatgttcttagctccaagagaacacgagttgtagaagtatgagtaaaagtagagtggttgtagaaaatttgaaacgtactgtacttgtacaagaggtcgcatcggtctccacatacgggaaggagggtctttaccgtcgtctatatgagttcaatctgcatgacataatggatgcttgcccacgagtggatccagaacaagcacaggttgaaatagagatttcactcatacagatactcgtacttgtactcacttggagttcgttttcaaatcacacaaataccgactttgtgttctttattgctcatgatcaactactgtagctacagtgtggacccctgtcacccttccgccaggcactgacaaagaacccaacaaaccttcaactaaagaagagtcttggtaagtaagtttcagggggtgtgaaacacagatttgttacaaacggtagctctggagcccttcaggggggtgtaggacaccttaacccgtaccgacagactgtaagtcgtctacaactctctctttacggccgtttatcattacagcatgtacttaataagattctatcgtatgttgtacgctcgtcggcatgcccctcatgatctaatgcaccccacactgccatgtctcgaatggtgcaatctgccgaagccatattattgtgcggggatagcagtgtgcgtttggacgaaggcttctacctactgcagtaggtaacggtgtcacgcggtcaacactcttgttggtgttccttgcagagggtcaagacagaatcctggatctaaaataaggaggggatatccagttgccaagatatgggtattgtcttgccgttacatgtttcaggggcagcagtgtgacgtcaacagctatatggttgtttgttctgtgttattaattaccccactggagcgaactatggattaaattgagcatctgaataagacacaccgtggaatcgaacttactgtcactccacacatctgtcctcatgccaggtcatcagataagaacacgattggcttgggatgcatgtcggcagcaatgttcgtgcctcggtttggaatcgtgaagaacgtcgcactcagaaacatcgtcatcaccacacgaataggcaagacgttccactcatccaccatgtccgagtacccctacatttctgagccgcagacacctgagctgccctcctaccactccaaaatccagggcattgccaacaagttccgagaagccggatggactgcctgtgacgcagctgacgctcttgtcaagcacggcgacgagtctggaggataccttcccggtctaattcagcagtctttcaactccaagactcctgtgaccgttggtcctgcttataccgtcgagtacgcccctctggatgaccctcgacccgctgttaaggctggatacattgacgatgcccccaagggcgctgtcatagtcattaccacttctccttctgtccaattgactgctgctcccttcactcgaatctctaacgcactttatggaggtctgatgagcactcgagccaattacctcaagtgtgctggaactgtggtctttggaaagattcgggacaagaaggaacatgtcgatctcgattaccccgtgcactcttatggtctgggaaccactgcccccggttctgctgtcaaggttgttgctgtgggcgagcccgtggagatccaagttgctggtcaggctggaaaagatgataaggctgagacccgacgaattgccgccggcgatcttgttattgctgacgagaacggcgtcgttgtgattcccgaagctgacgcccagaaggtgtctctctacattcctgctcgagtcaaggccgacactcttgttgccagcgacatcaaggagggagtccgtgcccaagaggcccagaaggagcgacgacgactcatgtacacccctctgaacgatgaggatgagtgatatgaggatgttgaggtcgagaagggcttctagacttcctggcctcagcaatgacttatgactatagatgatatagagaagattatgacggtaattgtggggcgtgtatgtaccgtatgtgtctggagacacccagaaatggaaaacgtcgactacgactacgactaccagtactacaattgtagtatggtgcattaactacgcttccattgcatccactcccgctgtgtgtctaagacagatcagttgtcttagaatgtcaaatcgagcttacagtgcgcgggtacagtacagtaagtgagtgatacatgagcgtgcgtagatgaatttcgtgactgatcggactgtgtaagtccagctgggtgactcgtatttcttgccaatgacagttttttgacacttgctatgccttgtcaatttagcatgtgtagccaaaagtcaggcatgctggcataaacggtgatttacaagtacaagtacaatgagttatatcgacaccagtaaaccatagacagcaagatacaagtacaagtacgatgtattcgcacttcatttcacactctcgtctgatctgctatcatatactgtcaatatcaactagcgtcaagaatggagctagtctaaaacggacataacactacaatccaagccagatacgtatttgtgcacaatacaggatatgcccgacgggaaaaccgtcacacccgccatatctatctacccctaaactcctgtgttccctcctgtgcgtgtgtatcatatggcaattgagtcttcgcctcgttgacggaaggggtgcaccttgtgcttgatgcatatacctgacaacccctagcgtgctatctatctagagtatgaggaggaggtaattgctccgtacgcacccctacgtagcgctgtcacgcctcatgttgcacggaatctccacatgatcgtcgtccctgcctgaaccagattttgttcgatctacactcagatctacatggcagcccctactgtgcctttctgctgcaagggacaaccgaaattgcaggggtgccaaagggatgaaagggagcagacaagcagagaagacaagagactgggtcttgtctcagtacaagtacgcgaaccagcgtagaccaaagggtttcaagagcgtacttgaggaaacgtgcaaagatcgccacagaaggtagggtgggcatacgttgagccgtgggcgtgtgaaatctggtcatgagcaccaaatcgttgcgcgaacgctatcattactggtgtagaaccaacatgtcacgtgttttgatctcgtgtagcatcttactacaagtatcgtaattgcttgtaattagctatcgccatggagatgtaaaactgcatggcgtctcgactcgaaacacgtgacaagaatgaagtaaagttgccttcaaacagggacgcattcacgtgatgcgaagtgcagagggctgtatatgaaatctcacgtgattactgttccgaagagtatcgcggttctgcctctctggttagacaaattccacaagtaccccttgtagagacgaagtagatgtgaggcacattgacgacagagccgtgaatacggttgggcatgaggaaacacgttctcgcaccgtgcgatggaaacggtctttcacgtgacctacgcgtcccaaagcaaaccagagaacggtccaaaacgctgttgcagtagtttgtgtttcgcgttttctcatgcggcgcgtcgttgacatgcatcatgcatgtaggatgtaatgggggacattctttgcgttgcatatattagatatatcagattccaaatgttgagcttaacgcgaatagagtgttcataggagattctggagaattggaaatataaggacatagcggatatagacagagatgttgagagaaggaagtcaaagataatcggcagtaaacacgactgtattgatgttgatcagtgacaataggtgcgtatatttgcagtccagacgtggagcaaaacgtaaagaagtcgtgtgaaagttctcttttgatgccctccacaggccattgtaacacaggtcaaagtagcgagcgacgggacagttgagaaatctaattaacacacttgtaatatccgttcttgggtccaaggtggagggtcgaatattatattatattggagacacaggtgccatggccgcatgctgtcagacaatgcatgatgtccgaaaacagcttcgtcggtgcactacttgtacttatattcaatattaaatcccagacggattcaggcactggggaacactggcatgtgccctctcctattatctctatgattggatgcgtgtgcatgcccaacggtctagttgcgagcttggatgtctttcaggggttagtgtgacggcgtaaccgttctaaaccaagtgagacagtggattcagctacgcgaaatgagaaatggttgcacgaagacgcgagacgcgactgatcaacgtgcgagggcgatgaacagatatttagagctctctcttctccccagatggtttcgagtcgcgttttgaaacttgcagaattcaggtgagttttggttggaatgaatgagacattgggcgtgaagtatggaagccattgggaacgcgtatactgggtgattgggcgccgaattttcgtatatatatcaattgaaccatacagaatcgacttatcgcgaaatcagtcacttagcacgattttctcgccctattacagactgtcaccaagaatacgatgttccaaaaataggcaaaaaaactaacttgcacataaatctgcaaggtttatttcgcgaaatgcggaaacgaaaaaaaaacagtgagatccggaggcttgagatatggagacggtctgaaaaatagaccaagcaaaaggtacgaagagtgcgacaatgttagtgtattaggtatactccagagtgcgtattttgcctgtttttggagccgtatcggccgaatatcagactctgggtttattgcccttacaatctcaaacagctcattacgtcaagcgcatgtgcagtttcagattcgaaataagctttggggtcgtgagcaatgtgaccagtcgagatctgggcaaagaggagggagtagtggttcaatttgaattattgtcgcttcattggatagagaaaaaataaatacataggtctgtatgttgataatgggtcttaaaaattacgcctgtttttgcgcattttcacgtcttgggctgaactcgtatgggtggctgtatttgactcgcattttttgggaagaggcaaaaacgctcttaaaataagctctggtgctcaaaaaggtagtgcttcagccagtggatgtggcaagatccagaaggtgagggataatcagacgacagcattggagatggaacaccatgaatacgagaatcaacagacggtgataggaatggcctaacaccacacaaaacccccttaaacccagctcacgctaacctccacttgctagtccatggctgccataaaatttgaccatggccctgcctacctcaccatgcagatctccaaccctgtcgaactctgatgtctcacgtcgggcgggcaactgggctcaaaggggatcttggtagagggagtgacggaggctgacggtctggatttgggttaaacggggcgggccacgaccgggtttgggcccagggagggcgctcagcacgtagttggacttgcttttttattttacatgcctgtgaagatagcatctcgtgtgatcagcccgtcattaagcgggggcgcgtgtgcagcctaagtagttttcaactagtgcaaccatagacggtgggactcgaaacaaagacaagccacggagatggtgaccagcatttactggtagactcttgggcgagagggtcaattagcgcaagtagagcatccgcaatagcccctagatagaggctggtccagcgggaatcgagtcgcatggccgtcatcctcacgtcacgcccatacgagtccattacaacatctacacaagccttatacccctgtgtcaatgtggtcacatcacatctggaacaagcaggggcggaccaacagagttcgtagggaaattagttgcccaaacggctggtgatcgtcacagagaaacaagacaacaagagcggagatctctgtaggggttcaagagaatgtgttacgagcggccccgaccagcgatgaccccagctacgagggcggtgatgtgcagacggccagcgtaccacctccagcgtctgtacaatcttccgccccctacagggtgaaacggtctcctcactccaccacaacggatccaacgctacacgcaagagtccactgtaagcacctgtgcagagacccaagagtatccgtaatgctattcactggggctgttccaggtatgactgtatgactttgtgctgcggtcgagtctccaaaaggagcgtccttacggagccataacctcttgctgcatctacagaataatacgggcggccgtgtgtgtgtatttttttgggtcccttgcgtgcaccagcctcgcaaagtcgcttctcacgtcccgtcacactacccataccaacccaccccttgatggattagcattccagcgacgccgaaaatctgcaaagttcaagaccccctgctgactcctgggttcccaaatcggaccgctggcccctttgaactctgttttctggtgcggtccaacttaaggttggcgagcttgtgcactatgtggactcaaggtttcgcgatgcgtctttgtgccccagcctcataattaatatggtcagctcttatataaggctggtggccgctagaccatcaaacagcatcatcatcagcgacacgttcctttataggtctgcaggcacgactctaaaaacactctcaccacacgcaaacagtcatttactagctcatacaacagacactccacccgcacaatccatcgccccccacaaccctctcaacttcacccactagacacctttccacgcaaaaccacaaatcaaaatgtccgacaagcaagccctcgaaatcttctgccagcagcgggtctcccgatccatgatccactacctcgtgtctaccacccagaccgtcatcaagtgcgactcttccatgccctctccccctccctctcccgccgactctcagggctcctctgcatcctccaacttgcccactctctacgagttcatctctcatctggttacctcttccaacgtccagacccccactctcatgacctctctggtctacttggcccgactgcggtcttctctgcctcctctggccaagggcatgccttgcaccccccaccgaatcttcctggcctctctcatcatggccgcgaagaacctcaacgattcgtcccccaagaacaagcactgggccaagtacaccatggacctcttctctctgcacgaggtgaacctcatggagaagcagcttctgttcctgctcgactgggacctgcgagtccgacctcaggacctctacacccactttgccgtcttcctttcgcctatcaaggccgagctccgagagcgatacgccgtcgagcactctgctccttcccgacgagccgtcccccagcaatctcatcactctcaccaggtctacaagagctcatcgatggccaccgcaggtgttccccacctcacccactctgtctcccctcccgagaccccccgacctcacactcgagccccctctctcaccatgtccgagtcctcttccacttcgtccatctcttccattggctccgcatcgtctaccgcatcctactctcgttctcgaccccattacactctgccccagcagcactacgtcaagcaggagtacaagcacgagcactacaacgtgcctcagcagcagtactacgaggttagagcataggtcgacactctttgctgacgacgacaaaatggtgatactccaaacattgacattgacattgacattgacagatttgcattcaacacacccttcgaaaatatcatccctactaacactactgctgggcggtagtcgactttcatttagattcttgcattaatacaggtgtgttccaaacattagtatcgtactcttttcacagtagctcgtcctttttagtattgtttttgttatgatcttagtcttgcaatgacgtcaatgtaacttcttggcggccactatattttttgtctactgggctgggccatattacatttgactaatatcttgggactcgtacatcttcccactcaatctcttttttgcagtggaccctgagatctgcgcggtctgtatagcgagagtgcacttgttctggataataataattttttttttgtttttttgtgtggtgtttgtgacgtcagatttctttatgaatatggtacaatggagggatgtgtttgatgttgtactgttctggatagtggatccgagcggtgcaagatctgatgctgtacacttgaagttacaggttgtgttctgagggtaagaccattaaaagagaactacgagaagtaggattagtagaagacgagtgtctatccgacagataactcggttcctttttgaaaccggaacttatcgtatatctcatcacctacctatatttgcttcttctgaatgttgtgatggaaactgcggtgagaatatctggtgcagtgagattcgcaggttgtggtaatatcgagtgcagaacaatcaaaataatggacacgattggcacaaaacccaactgaaacacctgtttgcatatgtgcatcaatgaaaccgttattcccgcgcccccgctacagtagtcatcgaggtaagaaaagtcatgtactggtacgacgtacatactgtagcttcgtggatagggggggcttctgtaacttgacgcaaaacgtaaagacaaggtgtggatatggaggtatatattgttgaaaagtgctcagattttgctggagagaaattaaatctattgaggtatatcttttttatttaattggcaagttagatgtcttattttatcactgtatcactctcactacagttgcttgtacttcgccataatcccaccctccgttagagttgaagtacccctgattttatgtatagacatgagcgagcactaaaaggactgtagatgaaaaaaataatctgcacagatagacgccgaaataatagttggtttattctgggtgtgccttgcaacatgtacatacgtagcagtaaacaaaccgataaacatggatactggtacgagaccgtacatgaaggcggtccttgtaaccatgaacgcaggaacggactaaacatacccctaccttctgcaagctgtgttggtatgtttacgtaatgagcgatacgcatgagataccatggtgcttgataaaccagctgcgagggacgtctttcaactcactatccccccatcactttcaagaagggctattgatatacacttctatagctctagggtaaaaatcatctatgttactccttaccaatgcactgaaccgagactattttagatccatttgaaacaaacattggatcgagtcactccaagatacccgtggcacacattcgtattgttatttgtccgttgcaataatatctttttaaaacacaaggcacattctcacagcttgcaggggtcgttagacagtctgggacactctaactacaggtaggagtaccctgggcggaaattaacaccctacaagtagctgaaatttaaaaactgagtaagatgacactaatggcggtcggagtcatcgtcgacttagcagatacgcctgtcttaggatcatgggtagacggggtgtgtgcggttcgaatgcattacaaaggctacttgtagtgtatgtacccgcgtcctgacactaacacgagagacagttagagcagagggtcatgctgcattttgttttagtcttgtttctgtcgactcatagctgggggtccagttgagttttagttctcaatatccatatactataagtgaaaggtccactcaattaaaccgaaaagtaatgacggtgcttcaattgatcccagttcagatgtactgtagaagacaaggtgagtaagacggccatatatttcttccattactatatatagtgcaagttttcctaaaagggacgatttgttgggaataatttgaacagatatagttgtattatgacttagttcgagctactcggaccccatggcatcgccctagactaaataaagaaaatgcggggttgtcgtctatgcaaagctaggaagtaactgtggcacacagaatccaagaatttatgaaagtatgtctctttaatgccaaattataccgtatatgctcattatccgcccagattaacacctctttcgtattgggaacatgtagattcatggcatagtacgaaacttggaaggcgtgatattttgaggatggtgtggacaatatgataatatgataattaaagcaaataagaagatatatgggactctagtaaatccattatttgattttttataccgccaaacactcggagtcaccgttcattctaatgatccattacagctatatacctacttctattaatccggattgctgatgttcaatatatcatacacatgacaatcgttgcgatgagtgttttgtgagcgtgtcagtggctgccaatgtcgttgtcgcttcatcatgctcttgtcccggtcacttttttttattctgatgattcgggggggggtttaatttctaatgagggttttttattttttattctaataattggtttttttttttttttttggggggagtgttcttggtatgtttttccgggttaagtaggttcatcactttttagacttttaagtaagtcccggtggccgagtggttaaggcgttgccctgctaattgataagttgttaggcagtgggttttgcccgcgcaggttcgaatcctgtccgtgacgatattttttatatgtcgaatttctaaatcacctgctgaatcacctgatcttgaatgcatgtgtttgtcaatatacccccaatcttttcttttttacttgtacttgcacattgtatctccatatgatctaacactgctacttctgatacggccgtgttttgagcttgtttcgcgcttgttttgatggccacttctgtaacgtgagatgacgatcatgcgttgctgggacgactaacagcactttatatcaagcggccaatcaacgtatgcaacccctgcaagaagcgcgaatacgagctgttaccatatattcgggagtgtaataagaccaataaccaataacggtatcgaactggccagtttcagtactcgtagtagacacccagtcactcctcctgtgcacctttctatctcctagttgcataccattcggccccatcggaactggtgacggagaatcaccacccttcagggtctttttcttgtcatccagggtgcagcaggttgccagagacacggcgattacctttaggattcggtgtctttatttggtgcgccaaaattagagatccgaggtacgttaccgtagatccacgatggaggttgcagaagaagaaacgacaggtatttatatatttatataacgccacagaacctgtcatgccactgctattgccctagaatgtagggccattcagctaccggtaatgtagtggataagccgacgacttggactcaccacccctgtccttgctctgagttacttgtagagttaacgtatcctacaagtagcccagatgtgacgtggttgcaacaacctcatgttgtgtatgtttttcagcgtgaataggtgcaggagagtgatcttgtggtagatctaaacaatcccatctaaaagtagttgatacatgtgtcactcaggatctaaaactccatgtttacccctatatattcgttacatcttcattatagctggaacacaattattagtacttatatattagtcttatcgaaaacttgcatacagtaggagtagcacttccccacatttggccacctgctcgaactgatgcttggacatgagtgctgtggcatgcacatcttgcgtggttaaaacggtgtttcgaacacggtagaaccaacccgcgagccattatctcgcaccgtttgtacaggcccctcgtttctccctaaatctaccacattattttcatttatgcagcccctggcgcccctgagctagttccatgtgataatactgcgagcaaaagacagctgtttggaatgtatagcgctgcggaaaatccgggtagatggctgccagcaagactgcagctccatatttacctatttggcggaattagcgccgttttgggactcctggcagccagtacatcgatgacagatcgctgacaccatgcacataatgcaccaaaaccttgggcctcaaactgagaccagatgtggttgatgcttgactggttgctcgaagtttgttagaaaatcgagagtgtagaaaagagtggctgactaacaccatggcatgagggacggctgacgcgtggcgcccatagcattataaaactctcctctgcccaccattgtccactagtgccttacgtggggaatgtctgcacctaacggttgatacacaaacagtcagactagcccagcagcttgttatcctggtgggagcgcttggctttatacttacagtagccgactcagatgcacgtctggcataaactcaaccacgtctcatgaagcgtgcaccggaagagatgcagaacaacgcaaaagggccttcttcaaacatggccgcaggagtaggacccagctcgtcctccactcgatcgctcaagagccagcgcagcagagacagcaagaattccgacaaggaacccggcttttttcgacgtctgttcacacacagtcccaagatgtctttcaggagggtgagtaaaaaaagctggatggaacagttgcggttttttttggacgcgtaccagccttgatgacggtgccatatcacgatattcgaaagtgctagactagtcgttagttgtgacaggttcttttttccgattggccagagaatagggggtacactcacttacatggcgtgatgatgggacacacggtgttgcgcgtggtcggatgacccgaatggtatggtgctatggtgagaggaatgaagtggcactttcattacgacatgataaggtcgcacaacaaatgtcatgtgatgttggtatggttatgccagaggatgatgatgatctgtgttatgatgagctcagaaatcaccacttgtcggccaggaaaagcagttaaggagaaggttaggtggtggaccgcacgtgtgtgacatgcgctattctgtatcactttcatgccgtacttctattgtctcagtggtcggtatttctgttgtccttggcacatcattatcgtgaaattgtgatttttcacttctgttcagatcagcccattcctccaaatcttgtgtccactacacttgcctatttattcgagtttcgacttgaaagcaatatttcgtggatagtctgacatgagtgtcatcacaatgccacctcaaaaaaccactttccatgttccaccagaacctcggagcgtcctccgagaaataccgttacaacagactgagggtgaaaccacccaagctctagcaccccacatttactaacccaggatgaccccgccctgtccatggctatgaccgcggtggtagatcaccccatctcggacgacgatagtgacgactacgagttcgacaaccacacaatcaataagagcagcagcaaagaacccacccccgagcccgcatcttccattgctcccatggtattccatcctcctccaggacccactccccctcgagacttcacatcgtcactacgcgacaagcgtaccagcaagttttccatggcctccaatgcctcgtatcattctgctcgcgacgacgactcgattacctcgagtcaacttgtcacgccaaagcacgacgtttctattgacgcctacgaccatagccaccacatcaacggcactccgactcgaacaggaacgattcgacgagacaacaaaagcggagatgtgtctgttccaggtacaccagttctaagcggtgacagtgtttcgcagcgactatttaccggaggcacacccagagaaacgactccaggcagcggcggaacagttacaaaaaagagcaactcaaacacatccatgggtcccccctcagcgccccagcaggctcaccagaagcacgacaatcaacaatcagataccacagcattcccccctcgacccattcccaactcgttttcgtcgtcgtcctccctgtcgtcacattcttcgtcctattcagacggaggcgacgcaatggcagccatgaatgcagcagttgctgctgcgatcaaggacgacggagccggtccagttgcagatggttctgatggcacagccagagaaagcatgcgtgattttggcggtggtcactctcgagacatttctgaacagtttggctcgttcaagatctccacatctacagacgaacccattgctgaagagaatgtcggcccttacgagaagaatgttagtcctcatgagaagagtctgcctcccattccaccaccgcaacagcagcaaggatctgtatctagtctggttgttaactctactgcagcagaatcagcagccacacaacagcgccaggaaccacacgtgcatagatctgttgatgcccagagagcagctgtggaggctatgcagaggtccagtggtggcgacatttcgcagacggacagcacagctccatctatttctgcatccagtcttgcccgatcgggaagtgcatccaccaatgctacctctctaggagctcacggagtctttggaacccccaccatcgacgatgcgcagtttgagtcttccaagcccagtctagtggatagtctcaaggccgctggggctgttcccgagattagaactaacaactcgtcgcgagatacatttgatagcatggcctcttccaatagcatggcctcttccagcgctgcatctacagacatttccgatctggcagagaagtttttcaacgagacatatacccaggtttcacgagatgagtacgccgcatggctcggagatgatgcccaattcaacaaaaatgtctgccaggcgtacatgacgttatttgcatggcagggagtgtcgattctggcgtctctccgtcttctctgtaccaagctatatatgaagggtgagtcccaggttctcagcagaatcatggagcggttcagtgttgcatgggtgcaagccaatcccacaaacggcttcatttccgtttcccccgtctacactaccgcctacgctctgattctgctgaacacagacctgtatgctgctgaccacagtctcactaagcccatcaccaaggctcagtttgtcaagaacaccaccgagactattgtcatggccactgagcagaagaatctcatagcggtgctgcccaacgttgagtccagagaaagttcagagatgcgtgatagcacagacactcttctgttggtatccaagccgtttgagtctttcaaccccacccagtggcttacaactcttcaggctattcttcgggtgttctacaactccattagcaagagtcctctgcagattcgggccgttgatagagtggctaaaatcacgcccatatcgcctatcgatacgctggcacacacgaacgcacagtctcgaagcagtagtgtctcttcgagcttgttttccaagtttcgactgaacaagaacaagaatgcagcagattacaacatgagcagaatcgacaacagtctacctgttccttccgatccctttggacgacgaaactccatccaatccaatttctctattgaaacaggcatgtcttctggctcgttcactatgcctcgtcaggctgttggctttgcaggtatcctctggaactctatggctcgagaagagaccagttctatgttttctcgagaggaggacgatgacgatgacgatttcatgcatgacatttcgcgtttagagaatgctcttcaggccgaagatgagcttcaactgtatggagctccgtgggccaaggagggccttttactgtacagaccctatgtggacccccactctggaaaacgaagtcgaaagacgaagtggaaaagtctgtttgttgtagtccagaagggccagctcaagctgtttgacttgtcagccaagaagtcgactttgggcggcggtggatttggaggaggcaccgttggaggtggaaactggatggagagtgctctgcaggtggatgcctggagtttgtgtcacaccatcgcgcaagagctgcccaaccccaagcgttcgaagtcttaccaggctctgtggtcgctgactctcccccagtatggtcttctggtcttccaggcaggtacttctgagattgccaaggagtttgtttacacttgcaactactggagtgcccgactgtccaaggagcccatgaacgaagccgtttccaacatggaatacggatggtcgtttttggagggtactacgggaagtgccaatggagatcatcttcagatcaaggagtggaagcctcgtggacattcgctggtggtcagtgactttgatgagaagcgccaacttacaaacattaaggattatttggctgcagttgagactcagctgagccaccacaacggtttgttaccccgaatgctcagtagttatacgcaaggctcacagaactactcccgtgcgcatgccaactgggagcgaaagagtcagtacctactgcagcagactgtaagattccgagtttacgtggatgctctagaagccggtattgaggatagaaaggaccctggtcgacgaaaatacgacgtgatcgaagaggaggagtaagaacattgaagtccgagacggatgcctaacaaaagagctgtgttgaccgcagctaaacccgaacatcttaatatacgtttgaatactgccctcagctacttgtaagttgaatcattgattataatactttatataataccttaagctcagggtgcgagaacggttatcatcgagagtttgatggttctggcttcttgtctctcatgtgggcttcaatcatggtttcgatttcagtcctaccaagaaccttggcccaacctacaggcgtgctcttgtatagaccatcctggatcgtggtgtctgctccacttttcagcaggaactgaacaaagtcttcgtctccgcgttcaacagcgacatggagagctgttttaccctcgtccactactttgttgacaagatccacctctgtgattgctcgtgagatgccccctaagtcccagaggtccacaatcgaatgaggagcgtcgtttcgaaccaaccatctagctgtctcctcattttcaaagtgcagagcaagctccactaatgacattccattggcaaggggaaactgtagactctgagaatacttgtccagtccctgaacgtctccttgacacaccaaccagatgattcgttgctgttctggtgtgtttttctggtacttctcacgatgaagccaccaagtggatccattagatgcatgtttgaagccgatccgctcatacatgacagttcctgtgccattgagagtcacattgttggcgcctctatcattcctagcgtatttgcaggccatcttgaccagctcagtggctatacctctgttggtgtattcaggattcacgccaacattgtacatccccggtgatgtaccgaagaagatgtcagtatggccgacaatcttctcttcaacctcagcaacaaacttgaccaccgttccatccttccacatccccctcacgtagatactgttgtcatctaaacttgaaaagggaacctccgcgggaataacgagattctcatccggctcgacacgtcgtataaccactccgtccatctccttctgatctaaatcagcatctttcagctcaagacccatccattgaggttcccagcccaactgaaaccctctcgaaagaagttgcgaggagatttcgtgagtatccgagttacttcttctccagactccaatggtcttgggcattggattgctggtatcagtataggtatcaatcatcttgtccagatcaacatccgtctgcttatcagccagaagcaccaccatggcatgctggcttggcccacaatcggtgtacatgaggtctgggaaggagtaaacctgtcccagagccaaggcattggcctcaaacagctccttgtggttcaggagcgatatttggggtattttagactcaaaatcgttgtggcccatgattgttgaggcggtggtgactgcgacaaggtttgcttatcatagaaacaaacaagctgagactcaatggagtgggttacgaacaacaaagtgacatcatggtgagtatcgtacctctctgtctatactacaagtagtatcgtactcatacaggggtaaaaagattgcgtgagaaaggttaagtgggcccacaatatgaggagatttattcgtaaatgtagagtatgtattgtaatacatgtagaggaatatatgaaatgaacagactcttatctgcaaaaagattgacatcaattgagtatatcttttctctagatcagcgatgattaccatgtattgtgtattatattcgattttttttaatttttttttttaatcactctcaaactcctctttttggctaaccagaacaccaactaatttaagctcttactgggacaattacacaacgccacctgtaagcagactcagtgagagtatccctcaaaccactgtgcaagtcatcgataacaatattaacaaccaatggaactccgtaaattgcccacaataaactatccacagtctcacacactcaagttaccccccaaatacctcttccacgtttgccacccaagcttactcagcagtgaaccttgccagcactaaccatcgcacccacacggaccacttcgtacaggacagattacatcaccataatcctaacaccctcacaattgattgaccatgtccaatcctcaagaaattaatggtgagtacaatgcgagacgggagtgatcacgtgagacgacacccactttcctacacacgattcagcaaccccgattcaacccacgattcagcttacaacatcatctggcatcaaccacatctgattctaacacaggcggctcttgtgtcgcaatggtcggaaaagactgcgtcgccatcgcatgcgatctccgaatgggctcccagggtctcggagtgtccaatgacttcgagaaggtctttaactacggcgacaacgtctaccttggcctgactggtcttgccaccgacgtgcagacccttcatgaggtctttcgagagaaaaccaacctgtacaaaatggctgaggagcgacaaatcgagcccgaaacattcgccaacctcgtgagttccacactctacgagaagcgattcggcccctactttgttggccccatcgtggccggcatcaactccaaaactgagaagccattcatctgtggattcgacctcattggatgcattgactttgccaaggacttcattgtgtcaggaactgcctcggacatgctctacggtatgtgcgaatctctgtggcaaccggatctggagccggaagacctgttcaacacgtgttctcaggccctcatgtgtgccatggaccgagatcctctgggaggatggggagctattgtttggattattacaaaggacaaggtggtgaagaagttgttgaagactcggcaggattaagcatcatgagcaagcgagtcatgttgggctaattgtggcatgggtctgtgaaagccggtgcaacaaagtgcggccttacgctcttcagcaccagcatgtaatgattatttaatagaatttttctctctactctggcgtaggcagtcgtggtggatgaaccaagtcatgtgatcggctcgtatctcaagatctggagagttaaaggcagggactaaagcagatgagtgtctcaacttattcgacacgagaggggtttactgattacatgctctttcaatactgtagcttcatcaaaagggatgtgggcagatatgctgtcttgtatgtcattgtacttgtacttgtacttcttatctgggtagcctctcactggatttgatattgtacagttactgtagctctcgtaggtcaactcgtacggtgccataaaatcattaacaagcactattcgtaacgtttgggattctatcatagtcgaggttcaagtgcagtccgtctacttcttgtggaatggctgcttggagaacagccgcgctgttttggacagagtccaatggatttcggacttggtgaagcctctgctatcggaacgcccaaacctccgacccaacattctggcagcattatttgcggacccccagcacttaccgaacccgccgttcagtatgtatgtgatacagaaggtccatccgtttcattagcccacatgcccatctgtgttaagcacggcctggagtctaacttgttagccagacaccgccctgtcgtaaccagggtggatttgagagacaagttggtaattgtttggtgtaagacactcaagattagcattgatttgacattaaactgctcaattccggaatgtggggtgtgtaatgagctctcttgcgtgtgcgtatgaaccgtttttacctgccctccactgatctggatcaatcccgtattgacgtcatgagtgaatgttgcggtaaaagcactaggattcatgttgaggagtaaacattagacgttatatgcagaaataacaactgtctggggccagggcaggtgcgtttgtacatatcgacaaacagtagtcatggcagaagtagctttgataaggaccacacacggatgctttggtagcgctgtgtgcatgtcctaatattggagatgggagatagtggacttatactgtatataacatctacctaagttatttacaaagcaacaatctatgtaggtggttgtgctcacatgctgtttcctctttctcagaagaccccaccatacacacttggtgtgagtataaagagattcaagcagagctcctcggttctttcaatcacacgagaacttcgcagaaagactgaaaaaatatccctaagcatgccatggatgccctctacgaaaatatttctctacagtatgagtacttgtacaatgtaactacaatgggcaagtaccagtacatcctgtactcggccaatgtgtaatgtacgagtacagtaccggatctataccagaaacacaggatgtatattggtatattggtatattttgacccagaaaaagcaacagcttactcactgtctaaagaagacgaattattcagtaatcactattcattcatggcatctccacatgactcatcaacccatgattcatggctctccctgacatcaaagaaacaacagacttcccaacaataaataattgaggaggctcataaccatatagccactgtactttgaaggcagtatttatacaggtggagagaggaaaacgcgctgatggagaaatcaacactcaaagggaaaccgccatccgggtaacagtatttgtcctctaagctgctccaaaactcaattacgcatgcactttcaaaatatgcacaggaatacgcaccgttgtggctggtgtggctgaggtcagatctcccctcccataccacgtgtgatattcccttctcttacaaacaatcaagtcagtagttactatttacaaatatatacacgttttcataatcactcagactgctcgacgggagcagcgatgacgggagcctcgtagcggggcagggaagacttgccgtccttctctcgtgcgagaatgtcaagaagaatcttgttggggccataagcctcctcgtccattcgtcgggtcttctcagcaaacagcttctgcttctcggtggccttggctcggttctgagatgcgtgctcgattcgagcggctcgcagacacagagtcagctgctgcttgacgtcgttgcagagaccgaaggctcgaggaacaaaatcctctctgtggcactcatctagagccataataaggggctcgcagcctgggttagtagcgttcgggagatgaagctggtggtaattcaaagcaagtcggtgtccagatgtaacatcagcgttggacacttccgaatgtgcttagtggttccactggccaccatctcatttaaagggtgtctgctgatccaggtttcattcaaacagtcataacacactgatgagctcaccacattaaacttgtacccttccacaacgttcaccacttccacatccagaaatgccacccacagtccatgtggtggctagttatcgtgcacgctgcgttcagaggaaacctgttgatctcaggtgatactttctcaaaaaaagtctcctttctgtctttactcactcttaaatcgttcttcctgaacctggggatgcatgttgtgagattggttgtgtggtgtgacaaggtaagagttcttgatgcatatattgaggcgttcgaaatagagttttaatgacttgcttaataatatatttaagttcggaacatgtgctccccagttcgacgcccctcaccgtaaaatatatgtcctgaaaaatgaaatttagattcggtgaaggtgcagaagggactctcaacacctcagtcaccacagccatgattgaccaggagaaacgagcagccgatttgaagcgacggaagaaccagatgcttctgtttggcggagccactctggctaccctggcgtcttgtcgactgactgcccggggtatttccagcagacgatgtgagtatgacacccgacagaagagatggatctgggtgaacacagacaaaccagctgggtgtctcatgtgatataccatatgtgagaaacaaacatggccaatgtcttttatgcctcgacattttactaacgtagacattcccaagatgttccaggcaaaccatatgcccccacagtccgacatggtcaaggaggccgctatggctgtcgtctttgctaccacaatggccttgtcgtccttcagtatggtggtatttggcgtggcatggtcccaggacgtgacctcgctcaagcaattcgctctcaagatgaagactaagctcggagcccagcagattgaggatgaaatccgaaatgcccccatgaccccggagacacaggatctccaggaccagcttgccggcgcattgaagaaggattaacgtggaggagcaacttgtatatagtttaaatgatgtatgtcagttattgatacggcttacagtgttactagtacactcctgaaaacacaatttgtacaaatacatacataaataaacatcattaaacatcctccatggtgacatcgagcgaagcagcagtgtcaggatcctgaatagaggccgcagtgacagcagcagcagcaacctcgagatccacagagtcaacagagtcaacaggagccccagaggtagtctctccagcctgcttggctcgctcttcgttgatcgcgtgaacttgatcaagaatatgggctcgcttcttgggctcaagcatcacctcatcctgcttatgatggagtctcatgggcttcagcatgattcgatccctagacttgccaacgtattctccagtagcaccattgaagtacatttccgagcccaccagctcggtccattgaccctcgtaggcactgtcaccgatcttaacgaagggcctgtcttcagtgagaccagagatctgaactggtgcgttggaagacaccttgctagaagccccggccttgcgggacatgggaggaacgttcaggggaatgaaaacagactgggttagtagttgctgggggagcatattacgtgacagcacattactaccgacatggtgatcagttcgtgatccatgatcgagacagttatattactctcacgtggtatctcacgtggcgggattccatctatattcacgcttgggagcacgtgacaagccttatttactcactactgtgtcggattcgccttcagcagcagcagcagcagaagcctcggcagcagcctttcgggccttgatatcttcctctgatccaggatcgaaaggaacgtctgggttagtcgttgaacagaattcacggttatggcatcacacatggcgtcagtcatgtaatgaacatgaatgtcaaccatgcaatttacacattgtacatctccatactcaccaaagccccaatgcataacttctccctcactcaggtagtccacctgcccagaggacttcaacttccattctccacagagtcctccctctttgtcaacctcgaaggtgtccaaggaacacacaccagttcgaatgtccaaggaattgtcacccactagggctcgcccaagcgcaattcggggagcagcgtgagatacaatgagaatagtctcgatttcgggctcctccttgttgagcttctcgatcaacacgttgagaaaccgcttggttcgctcgtgcagttcagcctcatcttctccgtcgtctccagcaaccactaggctgttgtaattcttgtcgactcgggggaaaaaacccttgagaacagcgttactcgcaggcttggggtgcgagcttctctctcgcttgaaccattctccgcaacctccctcggggtagatcgcaagatcaagatgatcggcggtcggagtcgcagtctcgatacatctgtagaaaggagaagcatagatacgctgaatgggaggcttgatgtccttgagatattcacctagctccttggcctggacaactcccttctcagcaagagcaggatcactctcgataccggtgggagacgggggaatgggctggtcggtcagccagttggctcggaacccgtgtcgggtgatgtagatggttttcaccatgttgttgttgtatcgaggaagtgtagatgttgatggtgataggaaactttgattgatgtactcatcgtacaatatgtacatgtacagtatgtacttgcagttgaaccagcacgaactcaaatggggtttgcggcttgtggacgatgctataaggaggaatagaggtatatgaagcgtttgacaggaattgagaccgtacttatacaggatttttgtgttagtgtttccatcacgtgtagatggcaagctgaatgtggtgttttgacaggcttcctctacttcctctagcccacgtgtgaagaagaagctactgtaactaaacgtatacaatagtgaaggaggtgtagagggcacaatttgtagcaaccaaccatccattcaccaaatataaggatccaattgtagcacactctacatcaccacgagcaagatgaaacacgggactattcacaactatatacactactaggggtagaactgcttgtacttgtagatgtagtatcccaagttaagagaaccaagcacggcgagacccacagggacaggcttgataccggccttgatgatccggggaatggaggctccaagaagaacggtggaggcgccaatggcagtctcaagaccccagtcggcgttctgcttaagcagaatggcagcagtcaggtacatgccggagacggcaagacctccgtaaagggaaggcttggagttctttttgctaggtcagttaaaattctcgagcaacaacacaacgataagttctcgcggtataccagcattcatactcaaatatgccttattatcattttgtttcataaaacacctttttagtcgaatcataataccggcaccatcgtagcgattgtgtcgaccgtgatgtcacagccaattacagccattcgagttgatcacaatagctagccaccgtgttactcttaaccggccaaccacaatgcctccaaaacccatgccatacttacaggtagcccataacgccgccgagcccggtgagaccggccatagtaaaagcaggatgttcctgggttagtaattgtgctttgaggatgcctcaagatgcctctgtcgcgttttcttgctcaccatttttgaaggtgtgtgtgtaggatgagatgattgatgcccaaacgtcagattgattgattcatgtctggtgcgagtttaaccttgaagaagtgagtaatgcgggaaacgtatgaatggaggagtattgcaatagcgggttgggtaaaccagtaaagcagcagtcgttaattctactaacaacgaagctcacttgttcatatttctcaagtcagttgcttagggatggtagaagggctcaatatcagtggcaatttatgcacgtgtgtggcgttgctgacaaattgtggcgcatgaaacagatgttctagagtaacctattagatccttacacagtgaaaggaatagaattcggcggttaggagtactgtacgatacaagtgtcgataacggtacgggtacatggtagtccgtagctgccgctctttcagattaagagtctaattactattcgtggtgtggtgagatttacgaactcttgagatgagatgagcgaaatatagtataattgacagtacgagtattgtaactggttacgtggatcacaatagttacttaactacagctattactttccaagccgttatgaagatcgtcgtaccctctcttttattttctcaagaattaaacccatcaacttacttagccagcccaacaactctacttgactattcgctcacttgcgcgcacggggtttatttttatccagccccgccctacttcaccgcattgggtggtggtcatcacttcagccctgtctagccccttcgccagccagtgttgatcgttgcttgatcttcatgatcggcgcgtggtatgattgaccactggagaccagccagcgctatatactggttacatcgctacgggacctgtagggcttgacggaacgaacggttggcattcgaaactaaccatctaaagtgaaatagagcagaacccttaaaaagagtcaaaagttacgacagctatgcactcgccctgtgcgggtcttactttgttcgaggtacgctttctactctagagagacaagcagaggagtcaccaagtggaggggagcagtggttttcgtgcaagccttctgcacaatatcacacaggttggtctgagaacagagagaaaaaaaaaacaccagatcaagattgcatcattagcatctccagccgcaacaaaaactaaagcgcttcgacaacctgaaagtgattgcgtaggatttcatgcttctgtatgtcgcgcgttctgccgcatgactcgacggtttggtttgtgtctattattatgtcgcaatcaggccttgtatcaaagtccaggttctggattaatgagctgtagccaagaccacccctgcccagacagcatgacactacagccactggacaccatgtgacgctggggagagagatagcgaccataaccagaagatcacaggttgggtgatcgtgcctggaacctagcaaagttcgggagttgctattttgattctcagttggagatgggacgaaacgtttaaactgtagtagatttgctcgcctgcattttttttgccatataccagtgtcagtgtgtcaccttcgttcttgaccagtcacttccttccttgcaccgttttcatttgacgtactctcacagataagcgagtcttggcgaactctaacaaccaacgacaaattacacatttcaggatcacgcacacctaccaacaccacccaccaacacactcatcacacacacacctcacacatctcacgccaccacagaaatgtcgtctgacgaagtataccgatccacaggtcgaggaggagccggtaacattgcccctgtcaagtccttcgagcagcccggaatcgttgagctcaaccccggtgaaggcactccctacatcagccaggaggtctacaccaccggtcgaggaggcgctggaaacatgcagcgaaacgacaaccccgagttgacgcgaaaactccaggacgtggaacatcacgacgaggagcaggcgcagttcggcgacaacgatctgtctacagtcatgtcgtttggccgaggcggctacggcaatattgaggctgcccgaaaggcagagaacaagaagaagtcgctgttccaacgagccaaggacgctttcagtcaccactcttgactccctgacgtcgaggaagggtacgaaaccagcgaacccaatgcaaccagcgtgaccggcgagaccacacaagagactgcgaccgagaccccaactgctcctgccgaatcgtggctctcttcctggtacaaccatgtcaagagttatttctggtcttagaccgttatttatatgcagcactctccaacgtgctgtgtttgtttgttgtatgtagcttaatcattaatgtgtaagggtcgagagattcttgaggaggacctcatctccagagagagccacattccctacaagtactcgtactgtagaggatgtaaacaagtcgaataatcctgcaggttactgtcgctaaaatatccgctagccgcctgtcagaagtaaagagtcacccctcaagaaatggatgaagacgggaaggggcaaaaaaagtgaatcgtgactgagtcacctggtgaagttccggatatatggggtcaaaacctggaatacggtttgttcaaaagagatgcgaaggtccctagctcttttatctatatcctcatatgtacatacaagtatgtacattcgcgatgaggaggcctcttgtcaaacaaaacgtgatgacagcaagaaggaatcagtaacgaaggtatatgagcatttgcggtaatatacggtacgcaattgacgaaatatgtcttagttgacttggtactgctaaaacactggcgatgttccttacagatcaagcagtctttcccaagcattacttgcttaaatacagttcaagtattatagttaattaatacttatcttcatatatgcacaaaattagcttctgcatcccagaattatcttttacgagtacagtgtaccaattacaagtactggaaactccgatcacatcacgactgaatcatcaacatccatcacaatgagcttcggcaacagtggatttggagcaagcaacaatgaattcggtagcaacacattcggatccaaggcggtaacccctggagccttcggcaagccagctacaggtagtgccttcggagctcctagtactttcggggccagcaacagtaacagtggaacctttggggccccatcaggtggagcattcggctcaaagagcagttttggcagtggagacaacccattcaaagctgctggaaaccctttcgcaggtaccagtccgtttggagccaacaatgccgataccaataacagcggtggagccttcggtagtaataacacaagtggcggttttgctagcaacaacacaagtggaggctttggtaacaacaaaacaagcggaggctttggtaacaacaacacaagtggaggctttggtaacaacaacacaagtggaggctttggtaacaacacaagcggaggttttggtaacaacacaagcggaggttttggtaacaacaacacaagtggaggctttggtaacaacacaagcggaggattcggccaaaacaactctgcaggtggatttggcaataacaatactggtaccagtgctttcggatcaaatacttttggaagcaagccggcgaacagtgcgtttggaagtagtgcgtttggatcgaacaacaagaccagcagtgcgcttggtagctccaagagcgacactccgaatcctttcgccagcagtaacactggtggttttggtagcagcagcaataccaacaatgctgctcccagtgcctttggaaccacaaacacctctggaggtttcggtagcaacaccaatggaactacgagtgcctttggagccaccgctgcgggttcttcgacttttggccagaccaattctgcattcaacacatcgcataactcgccattcggccagaacaatacaggtacctcgccatttggtagcagcgcaactacagggaactctccttccggtagcagtgctcttaataaagagaactccccatttggtagtactcctgcttctggtattaaaacttcgacctttggaaacaccaccgcgcctacttctgcattcagtagctcggcgtttggatcaggcgacatgtcttctctcggggacgctctgactgtagccaagaaggagcccacgagcgcgtttggtacatctgcctttggcgcacctcaaggtggcggtgcatttggagcgactactacctcttcgtttgggcagcctcagaatgcggcagccaatctggcatctgtagaggtcgagggtgttcctgccaactttgtcgaagtgttcaagatggactactttacacccggaaagatcccggacgttgctcctcctcctcagttgtgccagtaagagcatgactgatctgatggatggagcactggtgtatccatacacacccacgcagtatttatatatagccgttaatagaagcggcgtcgagttgatgggaatcgtcgaaacaccaagccaggctgcatatattaccgattgacaatgtaccagtttcgtagacaggggggagggagacatccaattgcccatggaacagaagccagaaggaaaaacacagcggagaaagctggaaaaccaaatgaagaagaaaggatcatagttgacaatggcggtgccaccgatgagtctgttgtagtgatggacccatagccaccccaggtttcatcatctggctcggaggcaccaagccagagcagcgcgagtgtttcaggtatcggaggacagtgacaactcagtgagagcagtggctctgaaaaatccacatgattacctactgtagactctaaataactgatttattgatttattatgaatttattcgagtttgcgaaaaatgttcatgtctttgcaggcgctccatgttgaactggcggcaagcaggcacgctgcacataacatagcggacacaagttgtgataggccccaccagctgtctcgttacttttacctaacctcctacgatcacacgtaatgaagccctaccgaatgccgaatacttggacctccaaaagtcacgtgacaaccaagatcctatcacgatccaataagtatctttcttatttcacttcgcgccgaagacactccctattctatgcatgctgttttgtttcgccaccaactataacaggcaatttagacacgaactgcacgcgacgtgttttaagtgacgaacgcacccgtcaaatccaccacatctctgccccacccagactatgaaggtgctatgtgtggcggaaaaaccgagcgtcgccaaagctgtctgcaacatcctcggcggaggatttactactagacacacagccaacaagtttgttaaaaactatgactttcagtatgactttcctggctggggaaggtgcgattgcaccatgacttcggttctaggacatctgacagactcggaattcgtcagcgaagatgcgcggaagtttggttacaatgccgccagactcttcactgagcccattaccacccaggtgaaggctgacatgagaaagtgtgctgacaatatcgtcaaggaagcgcgacacgcacgcaagctactcatttggacggattgcgatcgagaaggagagtacattggatgggaaatcgtgcaggaggcgatcaaagggaaccccaacatcgaagtcaagcgggccatcttctctgatctggaaaagacccatgtccaccaagcggctcgaagtctacgggaattggatatgaatgcagtcaacgcggtagccgcccggatggagattgattacagaacgggatttgcgttcactcgactgcaaaccctgcacatccaaaggaagtttgcgcagctgagcaaatctgtcatttcatacggatcatgtcagtttcccacgctgggattcatcgtcgaccggtatcttgcccgcgaaaattttgtgccggaacctttttggtacatgacgctgaaatgcaaggtaggaaggaagcagatggctctgacatcgaagagaggacacatatttgacagagcgtctgccgtggccctatacgcccgtgtctgtgagtcaggagtccttccgaaagtaacaaacttgagttcaagaccgacttcgaaataccgacctctgcctctgacaacggttgagctgctcaagctcggatctaagtcactcaagctgccatctaagacagttctcaaactggccgaagagctgtatcaacagtcgttcatctcgtacccgcgtacagaaacagatcagtttagcaacgacatagatctcatgccgttgctggctaaacagaagaacagtccaacatggggagattatgcaagtactctggtagacggagatgcatttagtccacctagatggggtcgtcacaacgataaagcgcatcccccaatccaccctatcgctcactgtgctaatttcaagtccaacgatcacaaaagggtgtatgagctgattgctcgacatttcatggcatgttgttccaaagatgccaagggtcaacagagtaatgtggacgtggattggtatggcgagcagttctcagccactggcctagtcattctcgaaaccaacttcctcgacatctatccctatgtcaagtggacgggatcaggggagcttcctgcgggacttgaagtcggcaaagaactaccaattgttgagagtatgctggcagagggaactaccacgcccccgagtcttctcactgaacctgaactgctgtcgctgatggacatgaatggaattggtaccgatgccactatggcagaacatatcagtacagtcgtcaaccgtgaatacattctccggtgcaacgcacagggccgtccagtacagggccgagccaaagccgaatacttcactccttctcctctagggcaggcattggtggagggctacgattctattggtctggatcggtcactcacaaaaccgttcattcgtcgagatctcgaatcccagcttggccaagtagccaagggcgaagcatcaaaggacgcagtggtagagtcagctctgatcgcgttcaaagacatgtttgatttgaccaagaccgagattgtgaaactggagagggcgattcgacagagagttgcgtagcacgtagcactagaggggatcctatttatatatatatattaatgtctgtacaattgcatgcatacaatattaatgacgtctttgatatcttcattcaatatcttcaactatttacaccctcatccgctgtatttaaactccaatatcttcgttccattcttccgggtgggcagtgatgaactcgtccatcaattgcttgcactcgtcgttcttgaggttgaccacctcgattcctcgggctcgcaggtaatcatccccgcctacaaaggtgtcgttctcacccatgacaacacgcttgactccaaacatgatacaagctccggtgcacatatcacagggagacagtgtggtgtacatggtagcgtccttgtaaacctttccagcgagtcgaccagcgttctgaagagcgtcaatttcaccgtggtgtacggcggagccgtgttggattcgtcggttgtgtccctttccgagcacagtaccgtctccagcaaccagaacagcaccaatgggaatacctccctcgtttttacctgtgttagatcagcggatcaaagatcaaagatcatgggaaaaggtcaaattcgaacagtaacaacttagagaaatatctcagactctcactcactcttagtggcctgctcgatggccatggccatgtattttgcgtcgtccagagccatgttgatgatgaaaataagatgaaatttcactcgctaaaaatcaaagataagggaagactaatatcccatcgaacgttagcagcgtcggcggagtccgataagaactagagcgtgtacggaagcaattgggggttccagggcgaaaataatgccttggatgtggtttatcagtggtaatagcacgttgcaatatgttttgaggtcaaaatctcacttgcatcacgtacataagcgaagccattatcatagatggaagcccattcggatgttccggtggatgtgtcaaatgtgtcacagagcagtggtatctacaagtgctgataggacacaggagtggatttttagcgcggtctcttatggttctacaaggtagagtcatgaagccagggtctgggttgaaaaactgttgtaaccagtgttgcctatattttcaactagcgagtatgctatattcaactaatatcaatatgttcattgatatcgatcaagtattctacagtagctttttcaaaatctatggagtttaaagtacaggtatatgtagtcaaagaaacattacttctggtctcatagcaccgaataactgaactacagtactggcactatagtacagtactgtacagtacgagtgaggtgaggttagtatccgcagactaaaattatccaaccaagtttccccatgtccacacggagatgtgggagctgaaaaatgatggactgtttttttttctttttctgcatatacattcatttaatgtagtattatccgaatgggtgtgccattgtgatgtgattattcatcagtcacaagttcgtcgcaacggcgagactttcatacaggcaccataaaactgaaacgtgcaaattaggtcgtaataactcttcattgcctcctcatctcttcagatcaagcccttggagaacatccttgtatttactgtactgtaccatccggacccaatttttaggcttctatgcactcacccgtgtttcgtctaaaagtcacagatcccatacacttgcaacatctgttgagaagcccattgtatattattaggatcgtagcattattgtggcaaaaaatattcaagtgctcatgtgaattgacacgatcacgtaaatacctggtgaaattgctagtattcgtgatgttctaatacaactctgttcaatatttccggcgctctcttgtatacaagagcacaagacatgcaccccacattaaccgaggtcaagtgtttatgtatgaaaagtgacataaatcgtccaaaaaaaagtagcacatagttgtatggctgtaagttatgtgattgtcagttcttcggccttccaactcctatgcaccgtcttcaatcatctacccccgtgccccacaccccgcactattagagtttatcacagtcagctaaactgcttgcacatctacacctctgactacaccaccatggatttcttcagacggcaccagaaaaaggtgctggcactggtaggtgtggcgctgagttcctacctgtttatcgactatgtgaagaaaaagttcttcgagatccagggtcgtttgagctcggagcgaaccgctaaacagaatctccggcgccgatttgaacagaaccagcaggatgcagattttacaatcatggctctgctatccagcttgacgacaccggtaatggagcgttaccccgtcgaccagatcaaggcagagttacagagcaagagacgccccacagaccgggttttggctctcgagagctccacctcgtcctcagctaccgcacaaaccgtgcccaccatgacaagtggcgccacagaggagggcgagaagtcgaaaacacagttgtggcaggatctcaagcgaacgaccatttcccgagcgttttctcttgtctatgcagatgcacttcttattttcttcacgcgtttgcagctcaacattctaggacgacgaaactacgtcaacagtgttgtcgctctggcgcagcagggccgagagggtaatgccgagggtcgagtggcgccctcgtttggtgatcttgcagatatgggctatttcggcgacctttcaggctcgtccagcttcggagaaactattgtcgatcccgatctggacgaacagtaccttaccttttcgtggtggctgctgaacgagggatgggtgtcgctgagcgagcgagtggaggaagcggttcgtcgagtgtgggaccccgtgtcacccaaggccgaacttggatttgacgagttgtcggaactcattggacgaacacagatgctcattgatcgacctctcaatccctcgtcgccactcaactttctgagccagctgctgccaccacgggagcaggaggagtacgtgcttgcccagaaccccagcgatactgctgcccccattgtaggacctaccctccgacggcttctggacgagactgccgacttcatcgagtcccctaatgccgcagaggtgattgagcgacttgttcactccggtctctctgtgttcatggacaagctggctgtcacgtttggagccacacctgctgattcgggttcgccttatcctgtggtgctgcctactgcaaaggtcaagctgccctccattcttgccaacatggctcgacaggctggaggcatggcccagggatcgccgggcgtggaaaacgagtacattgacgtgatgaaccaagtgcaggagctgacctcctttagtgctgtggtctattcatcttttgattgggctctctagaggctcattcacgaaagacacgaagaacgaagatggggactgaatacagcgctctcatttgtacacaaatgatttatgacagagtaacttgtacatcatgtagagcatacatactgaaggtgtgatctcacgggatatcttgaagaccactcgtagctggaggcataggtagtgctagtacggatacttgcaccgtatccaacataagtagaggagcctcctagtggctattggtacaccgataaagatacacatacatgttattgccacttgtatctaccagtacccgtactgtatgtacttgtacagcacttactgttacttacatgaccaatgccttagatcgaaatatttctgatcaaagtagaaccaggcgtaagacgaaaatggacaggttttaccgaaagcccacgtgaacaggttactttctcaaaccttggagagagtggagagccagtcacctgaaacagaactctcatcctcattcatcgtacaaaacagatccctaacctcatgcccacggatagggacttctcttatttatagagattggacttattggaagcaaaagacaccaaaagactgtggttacatatggcccttgaggtgaatttgatagttaagatgctccactcgatccccatagcttacaatttgaacgttctcgtacttgggggcgagacgtttcatcctccaacacattcaccacctgccgagacatggtggcggagccctcggtggtgcggctgactagagttgagatggtgttcaggcggtctaggtttgagtcatttgttgcctcagttacgcccgtgggttccacaatcgcccctttgttagaccacaggccgtttctgtggaaacgcggcttgcttcaaactgcgttacgtttgactggctttaaggcattttgagcggtttagcaaagaatggttggagttcctagatcggaccgcagacaggtggagcaacagtaacccgtgcgattcacatcacgatccgatccaatctgtgtcttgttgacgcgccttttcatggtgttctgcccggtttgacctctcctttttgctctgcgggatatatgggaccaccaccgtcattgatcgtttgtttttgttggctcttacttctgctgttctcttgtcttactccaccgttccttcaagactaactcagatctgatgaacgaatgttgctcctgtcgttatgcagacgctgctctctcaggaccgtctgtgcggtctcgcagaaggtgcattgcaaaggagcattgtgtcacatgtctgccaatgcagggatggatggggaatgtagacgtgtgccaatgctggcctccactgtaggacaaattgtgcctggagtttactgtgcccaactacagttcagaatacccactgacatcagcgtaccaagctcacgtgtcatcgcattgctcgcggaaactgaaaaccatacgaactcagataatgcttaagcttcagagttgtcaaaccaatgcataaaatgcaccctgtcaggagggctgccagagacaagtgaaaaagttgtgatgaggagaaatacgattgaatgccttggcaaatttcctaggttttttgacagataaaaaaccaggagagaaattgttgtgtcgaaacacttacctcggttttgtaattcattttcacctcaaaactaatacacggctgaggactgtgtggttattcgcactattgtgtcaagcagagttggtgctaaaactgtctgagcttgtgtggattttcttcggcagaaaacgtatatataagatgtgtccgtgtccatgttacattcatcaaatggtgctgttccaaaaaacacgacggctggtcaaaaaggtacacaatgctatgcactaccgagagagcagcgtgagcgacgacgaatttgaatgcttggctagtccagtgggcagctttgaggtcaagagtgtgacacgagatactccctccaacgattactactgcaaagacatggttaaatgcattcctcctagctatgatctcgaccaccccaactacaccaatctgaacactccgccattgactccaacgactccatcctacactcttgctctgacaacacacaccgtctcaagcacttctttaccgtccattgcgccgctggtttcgtcgcaagttgtggacgacaacttccccgtgcaggattacaccaagtgggaggctcaatatggccactctgtctgtcaggactgtctggtgtgtaccagacccttttgccggggcgaccagatccgagagctgccctgttcaagcacccttccccatattttccactccagttgtctgtttgactggcttacacaaagccatctgagttgccctacttgcgacagagaggtcttgtagtatttatttataatgcattaattacagtacgaatactgaacatgaagagactgtagcaagtgaatctgttgtacgttcatactgcatggttacaacggatggataacagaacgtaacgttcttgtcagtgcagatggcctgaacagatgtcaagtatggcgccctccagtgagagaacctcaatggcactttgtagaaacgaagaatctaggatatgtattccaccagtatttgcgctcgagactaagccaagacaacagtcgatatcggaaggtttgcctgaccaggtgagaacgtgggtcaggtatcgtccccaggtcctcaggaatggttgattccattaggcagattgtagatacagtaatggagctgttgtcaattgtgttcattcccagatcagtgagataatcgtaaacatctttctgttcttatactgtagtttattaagcgcccgcgtctgaagctccgggacagcgggacaacaccacatatgctactgtgaggacttagacggaatccatatgtcggatgatccaatagtgaagactacctcgaacttctgaggagatgagatgattttgtgtaccggaaaccacttctctgtctccgaaggcatcttattcttagccaacaccaacgaaacgaccttggattagatgtaggaactgccgctgcgagggcatccaataggaaatagagattaggtctacaagtggtagtgctcaataaacggtaataaggcatatcactacttgtagttctaatataccgagcggcctcaactctatccccaatgcgatatctcgaactgtatccacccaatatcttgaactttcatagtagcactgcgaagtagtattttgggtattggtacaatagattaaacctactaaatcatgaaccctccactgtttgtagtattggattgaataaattatagctatgcaaaatgttgatgaatgcgactgtgcaccgcatgcctcacgccgtatcaggggtgtatcttcgacgtttcaatgctggaaaatcggtatacttgaacttgggacaagacttcgtaggagtgattttcgtcttctgaggtgttggatgtgtagatggctcggatgatggtttctttgcgctctttggtagcttctttatgatctggaattcctggctttgcgagccatccttggagtttgaactgctaaactctacaacaataggggaagaggaagtcgaagctcctccatcaggggatgacgactttcccaaaatgaacttgttcataataccgaactggatatctgaatcagaagagagaacctccacatgtccaccagtgtctgcaggtggctcaatggtgacagcttcaagggagttgttgttatgatccgtttgttcagatttctctgtagattgcccagcgacttgtctagtgaatttcacagaagttttctcgggagtttgttcagtaactggctcatccagttcttgttcgagaatatcgatctcctcgacatctatcactccggccaggtcagtatggcgttcaatctcagagtgcccgttagattcaccatgacggttggtcttatccaccatatcctgagaatcttcatcttcctcgatgacaattacttcgtctggtagctgcacagtcttctgggccttgcctgcactcggtagtctaaacagctgtgccaggttgggatattgcgggtggtcctgtacctcggccacttcttcgatcgcccctttatccttttctctttcgttatccttcctccccaactcttcagtatctcctttatgctcggctccagttcctttttctttcttatccttctgctcctttccttgcacctttcctccattcttgtcctcaacaatcacagccttctcgacgtcggtgaaactcaccgcgttcttgaaactcatgacctcgtagtcgagaaacttgacatcagcttgctcctcctctggaagttcatgcgtgtaatcaaatgctggggacagattgagttgttccaacgtgtacatgcggttgtctatcgcttccatctcgcctgcgaaatcgagcaaatcaacactcttcagatccagcgacacaaccttgccttcattccagaagcgagtgaaaggcgtacctcgaacagacacagtcttgtgtaacagcttgtcataatgggctttaacacttcccatatctcctctccaaaggaatgatgccactactgtctctcccgacccgtcgtcaacctccagtgacacagacagcttgccatggatatcgttgttgatagttcgcacatcaacagacatgactgagcctgtcagtcgaatgtgagtaatgggatgggtcttgtagaaatgaatcagacgtgacgcgtagttcttccgggtgttactctcagaacgagagaccgctttacgatctagtcgctggatatcgtagcaactgagaggaacccaatggccatagtacttcgacctgtccagcgacatggtcgatgttttgggggtttgcagacttgggtactggtggtatgttgctggtcagctcaggtttggcttcatgcaggatgttggtataaattaaatctgagtttcagatcaatcgaactggtggcgaggtgacgacaacaaaagatttgatgtcgatactacagcagctggattgatgtagaagaagttttcactttttgtaggaagaaatcataagatttaaatgttttacacgtgattgctcgtatgttgatctctcttgctcgcccaaagtacgaaattctgatgatcacagtatagttaatcatgtaaacaaaacaacatattagttgaaaatttagttacgatatgtatcatctcgcgtacagaagttacaccacagcttgcattggcactgtgagggatgagcgcgaaaaatgcagaatgaggttactcaacatcgtcgtttttcataagagctgcccttattggcctccatagccatgttttgatcacacctctacacccattttacactggaaacgcgcgccgttttctcgcaacatccctactctacattcgttatagcactgtgaacaagccagccagttgatgagaatctagctgataattgagacgtaaccgaaacttgggttggtatattttgtattttctatggtttcctaattctcctgattctctttagtctcttgtaaacccccatacttcctatcggacatctccgaaccctgctcctccgtgcatgagcgtgcatgaagatcgttatcagcgccgtacaaccaccacctcttacacacacacgcctaccaatttatctcacgccatggaaagacatcccattacctgccatattctcgacacaacccgaggccgtcctgcggaaaacgtgctgtgccagatctaccgaattggcaacgtgtctggaggaccccagcgggctacctctgagactgaggctctgggcaaggctcgaaccaacaaagacgggcgagtggctctgtggactctcgaaaactcttttcccgagttcaccactgcacctcttcccggattgtacaagatccgtttcgagactgaacagtattttgttactgctgccaacggagatgttgagaagaccaaatcctttttcccttttgttgatgtgcatttcaccatccccagtcccgctgacgctcactaccacatccctctgctgatttccaactactcttactctacttaccgaggtagttagacatcagaaccacgcactgttaaattgcggacagagcatacagcctgatgcgccaatcaaccggttgaaacactaggcaaacaacaaaacatctcatacggaaagaaatcttttttacatctataaattattattacgtacgcattcttcaggggaatttcatcttccacagagccattgtcacacaactagctgtgatggccatggtaagattgacgccattgttgctgaggatatcagctcctgcaacagactttagatcagctgcctgctccacttttcgtcctccgctcatctccacaatctttcctccctcgttgactactgacttctggaagagagctcctagcaaggagtccagcagtgatccgcagaggcctacagagcccatgaacaagatgaacaacagggcgtcggcgatcttccacgactttcctaggggaaccaccaacacggtcacaatgccaatgtagagaccgccagcaagagccaccatgcatcccaggggggagatacctccattggtgcccttgggacacggttggaaggtggtaataagaatgggagggtacttggagagaattccaagctctgacgaaaaggtgtctgcagtaaccacggcgtaatgagcaatgaatccgaccatgagccagtccgatttgtcccacttggactgtctgccgtctggggacttgtaaattttgaagtagtagtgcagaatgagtagaatggaggcgaacacagagttgcatagtacctgggcgacggttcgggtctcgtggaccttctccttagcgttggtcacctttcgcttggtcttgattcgtgatctggggtctgacttttcgaaccgctcatccttggcggcctggatctcagtgacaatgtggtcgccacgggtctccgtgagcgtgctcttgaagtcggccttcatcttggtgaacttggacgagggcaggtagaaagcaaacaagagcaccatgcacacggaccaggggtggaccgcgtggatgattccggtgacaaccgcggccacaattgcagccggcgtcagcgacttgttcttgtgggctctccgggcaatttctaccagcgcagctgctctcagcagttttccagtgtgcattgttgtatgatggaaaggtacgcacggaggcgggataaggttggatgtgaatatcacactcacaaaatgtagctttatgcgatgtttcgaatatgtagcttatacggagagatcaaagtcgggagtactggtacagtagttagcagctgtagtcgtggataagagcaatatggaacagcaagtttgctgcgagagatgatattatgagtgtgtctttcacaccttagtcctattgtctgtgctacatcgtatagctatcataacactccatatacaactctacattaatatgtgacgaaggttactgtaggttaactcgatacgagtgcgaaacagcaagatattgtacgacatacaataggtaggtgaaaaaatacattgttataaatagtgaaggcatgaaatgagttccttcagaaggagaaaaaggactaactctgagctggatcagcagcttcagttttggtggtttctccagaaacgccgtttccattgacatggctctgggaagaagagtagttgggctcaagcacaggcaccggtgctggcggatccttgttttctttcgatgagcttagctcaagtgatgcttctagaggttcgttcttcaccgaggaagaaatcatcgcctctcgcacggctccttcgggtgcaaagttcatgattttgtccagcaagccctccttttccagccacagtcgccgtctctttctatttccgatcttgagctccttctgcaggtcattttgcagctgcagcgcccacgcctccttgcgtttgaggtcctggtacagtgttttcagggtctctgagggcatcgtctgtaagtccccatcttccgggtactccatgattctgagcactggtatggtgtccttgacgatgtccgtgatcttctgcacctcgttggttcgtcccatggtccgggtttcattctccagagtcgtggcaagagtgtgcagacttctaggctccaaatgctccaccaccgcatccacattgccaattactccactgtgatgggtcttgaattgcgggtcgcttggtcgcaattgctcggtttcgtgcacggttcgcatgtgtttggccagagcgtcacttcgggtgaaatttctgtcgcattcgggaacagagcagtagaagggcttctctccagtgtgacttcgcatgtgtgataccagcgcgaatcgcgacggctggaccataccctgtcgcgagcagccagcccaatcacattggtacttgctcttgcgggctccaaaatgcacctcgtttagatgatcgaccagagcgtccagattggctacctgggtctcacagcccacccagtgacaaatctggggcttggggttgtatacgtcgtcgtccgagtccatgtggtgggctatggacggcacggacgagtatccgtccgaagacagttcggagcttgacatctcagacatgattcgatggcgatgtgacttagtgatgttgtagagctgggttcgagtaggttatgcatgaacctaattggaagttgtgggagggtgtgggaagttggagaagggtgttgttttgtatcaagctaagactcggagatatgagtcaataagagcactctttaaggccttctatgaatcattgtgtactctaccctccatttccccaagcaaacaagcactgtaaagggggtttcattttctcatgctatgctgggccaacagtccattgaaggtggaactggttgatgccttattccaacaacaaatagacatgtctgtgatgccaaaatgaagaggggcaatcagcattgtgttcaaactcgtttaagtcaccctttgaataagtccatttccgcttcaaaagactcacttgttactgtatattgctacactaatcccactcgctcccgaagcgaatcgcgttgagacagggtcagcttctgtaggtctcgacaagatccgtgcaaagacagtagccacagaaaatggtcacatatggatgtatgaaagtggcgcgctatgctatttcaatgaccaaaatgtcatacagcccaccatcaccaccaccaagatgactaagctatgctgcgtacatttgagcatgactcaatttttccaatataatacctagagagagggaaaaaacaagaaattaccgccgttcaatttcaatgactatgttgtataaacaaacaatctccaggtatttatagctacaagtacctaaaaccgcagctcttgtcccatcttcatctctcaccctcacgactttcttctctcctacagaaccttgtgtgctgaaatttaccctcctcgccagacagtgaaaatattcaaactttactttgaacaccaccgcacaaccacaatcatggagtacgatctgacacagaagacgctgccctttttggaccgacatctcatctaccctctgctccagttcctcaagggccgaggtgtttacaacgacacagagctgctccaactcgagtatgacctgctcaaggacaccaacatgaccgactatctggtggagctgagcaaggagcttggccagaacgatgccgatctgcaggcaaagaaggagaacgttgtcaagaccctggccgagctggaggaggccaccaagcccgtgtttgaggtgcttgagaaccccgaggtggtttccgagctcaaggagaacaagacccagaaccaggctctgctgacctcaaagtacggtctttctgtcgagcagatcaatctgctctacaagtttggacagttccagtacaacgccggccgataccaggctgcctccgacattctgtaccatttccgagctctgtccaccgaccccgagctggttgcatctgccacttggggccgtttcgcctgcgagatcctcacctctcaatgggacagcgttcttgaggagcttggaaagctgcgagactccgttgactcgcgatctctggacccccagcagcagctgcaccagcgaatgtgggtcatccactggtctcttttccccttcttccagaacgacaccaagggtaaggatgctctgtgcgacctcttcttctcctcttcctacatctccactattcaggccgcttgtccttggattctgcggtacctggtggttgctgtgattgccggcggccatcctcacactgcttctgtcttccagaagcgactcaaggacctcgtccgagtcgttggacaggaggaatacgagtaccaggacccccttacccgattcgtcaagtctctgtacattgactactcctttgaggatgcccagaaccagcttgctgactgtgagaaggtgctgaagcaggacttcttcctcgctgactccgctgacgccttcctcgagtctgcccgaaaacttatgtcccaggtctactgccgagttcaccagcgagttgacattgctcagctgtctcagaccctcaacctgtcccaggagcagggcgagaagtggattgccaacctcatcaaggactctcgaatggacgccaagattgacgagagcgactccaccgtcatcctcaaccacccttcggtgtcggtctaccaacaggtcatcgagaagactaaggggctgaccttccggtcttcccaggttctcaaccagggagttaccatctagacagcccccgggctgtttttgtttaaggtgttgcggtcggcttagactgcagtgggatagcattagaaggaaaatgtatgaaatagaatgagtgtattggcttactatgagtaaaagcagagtttagctgggatttttccgcagattatataactactgtatgtactgtatgtaagtactgtccttgtattgtgttcaaccatgcattaacacgttcgatgccgacaacgtggatgtctgacagatctctcaatgggctgtctgaatgaactggaaattgggactcgatactgagcaagtgaaacctcagtttggcgtcccaacgaccccaacaaattccgtggctgctgggggccgtatttagtttgccatggtatgatattcaaagacaagaacgcgtgcttcaaagccacagggtacaagtacatgaacttgtagctacactcttactatgagaactctcgttcttcaagttccgtagatttgttctagaaatcaatattgtataaagtcagaataatatgtttatatgtgattgcaaggcaaatgcagcgtctagtcaatagatatggagcgccaatggctagtttaggccttctttgccttcttgtcgtcgtcgccgaagtgttccttgctgacgggatcaacgtcgatgatgtggtcagtgacgtcctccatctccgtgttcttgggggcaggggcgcttagaataacaacgtcactggactcggggaagagagtcttagcgggtcgaacctcgagtcggtagtggaactcgttgtcagcttcagtgtagtgggaggcaaagggatcgaaggatgcatcgtgggtcagaacaacatcaacaacaccaatgacctgctgcttgggcttgccctcaatggacttatcgagcagcagctcctcgaaggcaatcatctcctctcggccgggcaggttgtcaaaggggttctcagtatcaatcttagtctgtcggggatagagcatggaagactgggagattcgtccagtaggatcaagggtcagagactggccgtttcgagacatggcaaaggggtctaccttaaggatagaattgatatctcgctcatcatcgttgatagcctggtgaattcggttcacgcacactcggttgagtttctgcagatcaaggggacccttggtcttgtagacgagagactgctgggccatgccgacccatcgctggttcatgacaccaatctgagaagatgcgattcgagaacggaaccacagcatgagcagaaggaagggaggtacaatgatgaacagaatgggcatggtaatgaacagggcacagttgaagaagaagagagcgaggccgaagaacttgatccagggaggagtcacgttccaggcaatggagaagggtccatgctgagagtacttctgtttcaggttggggttttccttgttgttcatcttcacctgtctggcggttcgtccggacgagaactgtcgggagaacttgttgagctgggccatgacattgaccttcttgttggcgacacgggaggtggtctgtcgagagaaagctcgggcagtctgagagacggtgctaggagcagcagtctggaacgaggagaatgcagcaattgagcggggcttagcgacgcccaatggggtcactcgcagtgaacggagcagaagcattgtgttgtgtgaggggtggttaatgtctcgtttctgggaggtggatcaaagctttaaatataagagccgagagagcagattgctaaggcgtggggagagaattagaattttgggttcggatttgggcggtttctaaagaggctagttaatgcattttgtaggtatcctaatgagacacagaaaagtctcaccttcattgctagtcagtggggaaccgcacgttggttttttttctctcttgctcctacattgcgtgcagtagaagaggtctcgtttacaaccgcctcgccttaaaagtgttcataaactcccaagacgataaacttccaactgtgcagctatcatgtttggcaagcgatgagcgagaggaaggattgagaccctgtgtggcgtttgtggcggtgtagttattggagggatataagtgagttgcagtgagcagtttgtggcaaagagtgattttgcgagaatcgttccagaagaaacaacataacacacgatttagattttgatttttcctgcttgttgcaatgttttctctccaccctcttagtgctgcctttagttaacctcgtctgcagcccttagccggatcaaatttagatcgtctcttcacacacctcctcctacgtgtatcacacattatggcgccgcaaggacggaagggacaggcttctgggcagaagtcagatggtgcgaaaagaactcgagccactagaaggagtgtggatcgaaataatcacgtcgatctgaagaatggtcagattacacccaagatcgaggatgaggtcgacaagggtgaaaaatccgaagaacagtcacaagacgagaacggcaacgaacctgccaccaatgaaagtatcccagaggatgattcggaacctgactccgaggaaatcccttctggtgagtcatctccagataatagtgctgacgagtacatggaggatagtgaaccagagaagagtaacgaggatatttctgagccagcaactaagaaaagcaagtactttgccgattctgatgatgaagaagagactgatatacccacttcccatataccttactccaacatggctctacaccctaactcgctgtccttcattcaagtcctagaaaagaacaataatcgagagtggttcaaatcacatgatgccgagttcaaaaaggccaaacaaaactgggacacttttatcctttccttggcagctttgtgccacaagaaccaccccgaacatgtgcctgctgagattcctctcatcaagctgcagtttcgaatccatagagacatgcgattctcaaacggactgccctacaagcctcgttggatgggtggattcagtcctaccggatgcaaaggtatattcccaaaatacttccttgtcgtctggccctctcatgtggtcgtgggggctggatacagcgccatgggagatgctgatgtcggtcctaagacgttgaaaggactcaaggatgaaattcaggaaactgagggcgaatgtattgctaagatccttcgaaaggtgcaaaagaagtctgctggtctggtattcaaaagcagattcgatgatgcagaaggtctcatgaaggagtttctggaaatgaatgtgactgagaacatgtacaaatacgttcccaagggctatgacgctgagtctcccgctgctggattacttaagttgagatctttcgtgattaaaatccagctggagactacagtggtgatggaaaaagacggcgcccagatcatggccagctacttcaagttcctgatcccgtgggtcaaatttcttagcaagtactttcctccaggccggggtggctaactgtatatatgtgatggaatagatttcgttttgaatgattctacatgtgcgatagcacaggtttgtctttcaaattgtgacttcctgacaggaccagatgcattttggctacaatgtgaacatgtatgtacttattctaataatattaaccgtcctatgtatcctaactatcctcattcgcccgatctcctatgcttcagtcctggcaggggcctcagtggcctcagtggaagcctcagcaccctcagtggaagtctcagggcatcgctcgctgtatggtcgaacacacatgtccttgtcgaatacctcttcgcccagctttggcaacctgctggcgaacagcaggtacgaagtatgcgacttgatctcctgctcacacttggacacctcggtccactcaaagctctcatctccctccttgatcttctggcccttaccccaggggttgtatcctctgtgacccgactcggtcttggaccgcttggcatctcgctcatccgactcttcctcctccactccagtttcagtttcgaccttgattcgagcatttctcttagccagaccggtctctcgtcgggctttgacgtctctaaggcgagtgatagcctcgtccagagaccgcttcatctccagtcgtgactcccatcgcttagcagcaacctctaccatctcaatatcgacccagccggcttcttgcagagcctggactgccttgacaacctgctcgaagcaaggcgagaaacagcacactcgagagacaactgatcggtcaataactcgctcgagatggggaatagcggtccaaggggcaggaaggtcgaggaaaacggcagtggcattgacgtcgatgttctcaatgtcaaagccgtcgttgcacacatcccgatgcgtggggatcacgttggtcagctgatgacgctcaaactcctgcttggccagattgtatcgctcctcatgaaactcgtacgagtaaaccttgccggcgaggcctgcagatcgactgatagcgtgtgtgaaggaaccagaaccagtgccagactcaatcacagtcgatccaggtcgaatcttgagacgctgaacaatgtacgatgagtcggtggtgtacacaatctgggtacggtggggcaacgagagagtccatagctcgggagtagggtgaatcagatgaatgaagccctgcttcgacatgcttccaagctgagctccatacttgtccatgttgcggtgagggaaggctccgtatcgggtgttgaagagcccttccttcttttcaaccacaatgggcttgatggcggtacgggtcatccacccgagtaccagatctccatcctcgatcgtgtccttgtatgccgaaaacattgtgtgtgattgtggaaaagttcaaaatattttttggaattttcacttttagagttaacctgcatggcaaaggtgaattgatgagtgacgattgaagcgatagaatcatgcaaaaactgaagaaaaggatcgatattgggatgggaaggaattattgatactttcagagtacttaggaaaaagtttcagctatacgtgagtgactttatagtacatccactgtgttattgcgtcttatcaactgttccacctcacagcatcaggacaactcgtacaaacctcccaactcaaactgttgataatgtacagtagctctgagtcgaaggaggttctgtctctacagagtgattaagtgggattgccagatattcgctacccatggggtatcaaattgtagctaatgaatggatgaagttattctaacgccattcaccaccaccaggaagcatcagcgaacgacagacgcacataaagatttttaacggggcagcagataaataaggacacagatttaggaatctatagattattctctaacaactccaaattgtcaacaaattctctcacattccgggcacagtgccagctacttgaaccacctactgtaccacctctcaatcgcagtttcgaggttcacaaaaatctattagagttcatgcacaagaaattattttatttgcatcttgcaaatcacacacaccaacacaccatcacacgacatgcctcctctaaccgaaccgtttgtcctgtgcgacctgccccaaagctcgctgaccgtggccgacaaggtggctgtgcccggccgaagcgcaggatcccagtatctgctgggaattagccactcccaggctgctctctacgaactcaccccaagccctcgatctgtgtggactcacttcctgtccttgacccaggccgtgtgcgccatcacccagtatgctcctagcacgaagactggtgttgtctacgtctcgatccgggaccggaaaaagttttttgtcgagcgtgtcgagcgaggcgttgactccgaggacggaaacaagagcgctctgactctgtcagaggctgcggtggctgttgggaccagctccgatgattctagaatttacctggtgaccgagtctggccacgttaaggtcgctccagtgtctctgtttggtcaggctggctccggagacaagatccccaccctgtttgatgctggagccaagcagatcactgagtactctctgttcatgcccgatagccgtactgacgagttcagtgacggtcttgttgtgcttgttctcggctcccgagactcgtaccgagccgttctgctgggtctcaagtcgtctggatgcgtcgttcttgctgacaaggttctcaaggatatcgctaccgactctaagcctgcgttctctgccgtcgacaatgtcctatcgtgcttctcaaacaccactctctacagctttgccctcccctctctcaaggtgaccacccagattgagcgacctgagggtgtgtctggtaattcttcaattctggcaattgactctcgaactacactgctgtcttccaacgacaagctcacactcgtcgatacatactacgagtctattgtaaccgaggttgatgcgtcccagctctctctgctgtccttctatcccgatacccagactgttcttggtgtgcagccccagaagggtggcttctgtgtttccggtgtcactgtcgatctctcttcaggctcttctctgctcgactctgttgctcgaggacagggtttgcagacttctgccacccgagaacagcagcgacagcacgactggagaatgtccaacatccacatggccaagacttaccgattagagagtgactttgccaacctatctggctatgatgtggtggtcaaggctgctaagaagtctcagaagcaatctcaggctctgatggagacccttaaggcctcgcaaggtgctgcattcgattctgctctgctcaaatacatgaagcacaagaagtggctcaagcaaaatcccgacctggctttcaccgtgtacgaggagcgagatgatgcccaaattgataacttcctgatggaccagatttgttccctgttgttcgacaactatgaggactctgagcctgttcttaaggccgatcctcccgtcaaggctctcacctaccttctcacacactctcttttccccacgaaccgattccccaacctgttggacacatttgagtctcaccctttcctgcagcgtcaggctctggtgaacgcccctgccctcccttgctccaccctggtcaaggctctggcctcttctgtgtctgacgagattgtcaacgatgccgtcgttcgactgctggaggagttccgacccaccgaggttaccaagaccatccgaaaggagatctccaacctcaacggtctggtggagcgactgcagaagatggacgctggctgggctctgattccctgtgtgattgatgctggaggactgctaggatggaacctagagaccattcaggagctaaagaagtcgctcaagagcgagctacagacccagaccgagtctgcccaaaccgttgctatggtggacgccctcaaacttcgaatgatggctcaggagcgagtggcaatgcgagagcagtacattgagaagggagatgacaagttggatgctagttacgtggtggagaagttgcatatttgaaggactatacatacagacctatgacattagaggatgtttgatgagagtatctgtgggtttgtgctgcagtgctcaggctagttagaggtatagaatgaaaactattatatttgattgatcgttgaagttatggtagacatactgtcgctacatgataattaatacgattccagtagacggtattgtaagtacttgttcgatactgcctattgtacatactggtgtgtatgcagtacatactgcacttttacaatgggatatatttcagtatatactgtacagcagaaatctggagcccctgacagttaccaaaagttattaatgacctcacgtagcccgttatttgtccatgaataaattaaaataaatacattcgcgctctgagcatgtccagacacacccgatcagcgaaactgctttttatactgaatgaaaatctcctgtgttagccatttcctcttataagtaaacatcccatgctaaaaaataaaaataaaaatcatttagcatcttgtactcacggccaaagcagcaggctccaccgatccgtccttgcacatttcgtagcatattcggagaccctcgtcatccagcggcacatccagcagccgcgccatttccttgagaacctccagaatcttctgttccttctccattaccagatgcagaggtgccagtcgacgatgaggtcgatgaatatacggaacgcgtcgtgatataagttggtgtttaaggttcttcagcagagaaatggcgacataaggttggtgaagcaaagcgttaaacgcaatggaagtaaggaacagagatgggtaaacaataacaacttgttttgatcgtcgagtggagattttggaaatgtacgagaagccataaagatgatgtgacaccaatgatgtgattatggaatcagcgaactaattatggcatttgtgtactcgtaccgtacttgtacgatgataaagttcaggccaggcccctggtaagatatcgtggtttgggggccatctgactgactagagattgttaacgccgataggttgtatgcgttacaaacctcatacagtaactgtcttgtgagctcgtcggtggaaatatgaaacacccactacaagtaacagtaattctgaactaggctaatagtggggagcgtagctcggtcgttcaccgtaaccatggcaaccgctgtttgggtgtctgacttgacacaagacagatgagaaactccagccacatgtatcaaaaaaacaccgtagaagtaccgctacccgtgtatccgggttgacctaaaactcccgaagttacttgcggtttgtttggcggggtcgtcgggttgctctggattaccagcagtatgcatgagactgatgttgagtggtgtatcgtacgagtacatactcatggtacagcaccgatactacttgtagtacaagtacaatgtaccaattgtttacttgtagcggtatacgagtatgtacttgtaaaagtgaaccccttcgccattccacgacgtttctgtgtcatgtgttccattcgcacaagtaccactacaagtacagtatgtacagtatgtaggtgcttgtaatatgtagcgttccattctgactgtgtaatgtctgcctgtatcaaacgagttgaaacaacaaactgatctggactccatgaaatatgcacctaaattgcactgaattttcttgtaatatatcgtatgtactgtaggtcagtctagatcttgtatggaacctcacctcacgaactcgctttatttggtgcagtttcgccaggttgaaatgggatatcaatggcggtatatgagaggtaaaggtacagtaagagtagcatcataatttatttatgaatctctactttatttgcccccatcattccattttacactgttgtacaagtgctacaagtatggcaccaatcgtttctactctactttaccaccgtgacccatctcgtccgctaatcaaatgtcccaaaatgcgcttactgcacgaaatgcagtctagagccgataaggacccgggtatggggtaggtctgaggagctcttcaccacaagcttgttgaaaggagaagtgatgttccgagataacgcttcgcgtgtctctctgctgttaaaaaatgtcaatctgctgttgaaaataccgccatttacaccggacaataacatccgactcctctcaactagacccttccagaagcctaaagttgctcccaggctggtccctcggtcagaacctaaaccccatttaaccaatttttagcttctatgaatcaatatttcactgataaatttgaatcaccgactaacactaacctcaacatacacacatcaccacaatgacttctatcaaccttggccaccccgtcgacatgcacgtccacctgcgacagggcgagatgatgaagctcgtcacccccaccgtcaagcagggcggtttctccgtcgcctacgtcatgcccaacctggtccctcccgtcacttctcccgagcgagctttggagtacaagcaggagctccaggccctggcccctgacaccgagttcatggtcaccatgtatctgtctccagagatcacccccgaggttgttgctgacgctgctaagaagggagtctccggtatcaaggtctatcctgcgggtgtcaccacaaactccgatcagggagtctcttcatacgagcagtactaccccgtcttccgagccatggaggagcacaaccttgttcttaacctgcacggtgagtgccccagcactccccagagcgacatcaccgttctgaacgccgaggagcggttcctgcccacccttggagagctcaacaagatgttccccaagctgcgaatcgttctcgagcactgcaccaccaaggctgctgttgatgctgtcaacgcctgtgatgacaacgtctccggctctatcactgctcaccacctgtctctgattatcgacaactggtccggtaacgccatcaacttctgcaagcctgttgccaagctgccctctgatcgagacgctctcgtggctgccgccacctccggctcacccaagttcttcttcggatccgactctgctcctcaccctatcaagaacaagcgaacctgcaacaacgcccctgctggtgtcttcactcagagccacgctctgacctacgtcgcccaggtcttcgacaaggccggcaagctcgataatctcaagaagttcgtcaccgataacggccgaaagttttaccagatcgagaacatggccaccagcggccccgaggtcactgttgtcaggaaggaggttgtcattcctggtctcatcggtcctgaggacgacggtgttgttcctttccgagccggcgagaagctcgactggaccattgaatggaactagtcatttgacggttagaaatcgttaccaaaaagaaaaaacactacagctaatgaattattgaatacaagaagtaagcaagtatagacagaacaatggtgtgctgatgtctgcatcactttggcgggcagatatatatgtactgtaccaatacagatgttaccaacacatacgatactgaagattcaaatagaatttcatttaaattatcgtacattcatacattcctctctccgcttactaagatgctgtcgctctgcactattaccaaccaaggcatcagtgtgcggcgcacatggtgcccgatcgaaccttcgtttgaaatgtgtggtctgctttagaatagtatagaatagtatagaacattatagagatgaggaaggaacctaaaggagtaatcaacaagtaagggacgcttacaaatcgacatgctttacgcccacttcgattctccttgtatttatcgccacttccacactcttccccatggttccattaagctgctttgcaggccagctgcaccaagagcctaaatttttttattgggtccatttatttaacatgtatgaaatttccactgcgaaggcaacacaaccatacacaacacaacaatggctgataacacaaacacaaacgtgcctgtacacgatgacaagcgacaaaaaaccgaggaggacgctgagatgtttcagtcggtaggagaccacgcctccaatgtggacaaccaagtcgacagccaaggtctgagaaagaccggagctgaggatgccgagggacacccagtacaggagattgagtctttctgtgtcaactgtgagaagaccggaatcacccgactgctgctcactcgaattccttacttccgggagattgtgctcatgtcttttgagtgtccccactgtcatctgaagaactccgagatccagcctgctgcccaggtcagcgaaaagggcagcaagtacatgctgcgagtagagaagaaggaggatctggcccgacaggtggtcaagagcgactctggaaacgtgaagtttgtcgagctcgatgttgagattcctgccaagcgaggccagttgaccaacgttgagggtctcctcacccaacttgctgaggatctcgagagcgaccagcccgtgcgacagcatgtggacccagagacccacgcgaagatcgaggaatttttggccaagatcagaggcaccattgagggagatgagcagcgataccccttcaccgtccaggtcgacgatccagctggaaactcgtggatcgagtacgttcccggagagccctcttccaagtggtctcacgttgagtacttccgaaccaaggccatggcgaaggctctgggtctgtctgttcaggaggatgacacccctgctagaaaccaatctgttgcccaggctgtgaacgacgcagctccctctattactgctgcttccgatactatcaccaccgccgatggctctgaaattgagaacatgcactccgaggtccaaacctttgagtcttcgtgtccttcttgtttctccaagaactgtcccaccaacatgaaggtggtcaacatcccccattttaaggatgtcatcatcatggccactgtctgtgaggactgtggatacaagtcaaacgaggtcaagaccggaggagaggttcccgagaagggtaagcgaaccactcttctgtgtgatgaccccgaggatctgactcgagacattctcaagtccgagtcctgtagactgcacattcccgagctggatctggacctgacagccggaactcttggaggtcgattcaccaccattgagggtctcctcaaccaggttcacgacgagcttgacgagcgagtcttcactcagacttccgactccatgactgtcgagaccgagcagcgatggcgaactttcctggctcgactcaaaagcgctgccgagggcaagattcctttcactctggtgatggaggaccctctcgctgcctcttacattcagaacccctttgctcctgatgctgaccccaacatgaaccatgaagacttcgagcgaactgacgagcagaatgacgatcttggactcaaggatatgaacgttgagtcttaccaggagcagcccaaggaggaggctaactagattatagaaacactaggagtttggagtgtaagcatgaatgatagcgttaatgatattaatttgtaatgatacaaatgtgtgtatacgtgtaggactatcaggcaattcttgagcggtatggcaatattacgaatattctacatacctgtaccccattcgtagatcattgtaacctaactgtacgattgtacatgctgtaacggcaccatcgcctgaggtgtgttttctgaagtaatcatcttctactaagagttttgtttttgtcattattcaccgttcggttggtctctttccttcgatagagttgtattcataaatcatcattcatctactacttgtactcgcttcttctttagtcatcattctcaccctcctcgttctcgtaaggcacctcggcctgaggagtgtatcggtaagcatgtcgtcgagctccatctgaccagtccagcagggcagtgtgggaggttcgtcggttgtcccagacaacaacagatccatcttcccatcgggctcgaacatggaaatccgatcccttggcgattatgtcgtacaggaaattgagaatcagatcagactcttcctgcttgagaccaacaatgtttcgggtgaactgtgggttcacgaagatagacttcttaccagtggcggggtgctttcggataatgggatgcacgttctggacaggttctcgtcggacaacacctcctcgtcggatagaggcgtcagcctgctcgtgagcagaatgaacagccttgagtccctcgagtcgcttctggaactcaggagagagtcggttgtaggcctcggtgttgtcagagaacaaagtgtctcctccggttcggggcatctcgagaataccgaggaaggtagttccaggaggttgcttctcgtatgtgacatccgagtgccaggcgacagaagacaggttgctggaaaagtactccttgtagatatcatctccctcctctcggaagataaggtgaacctcggggtaagcctggggagatccggaggtgggatgaatgtgctgtcttccaaagtgctctgcatacttgagggcgtccttgattggaagctctctgaaatcctggtcccggaagacaaccactcctcgctcggcaacgaagtaggcaagctcgtccttggccttgtcggagagcttggaaagctgtacacctcggacctcagatccaaacttgggggtgaggtcatcaacagagtagccgtacttagtcaattgctcactaggaacaaggtactttttgtcattggtgggaagacccttctcgaagaggttgggcagagtcttgtcagctcgcttaccaggctcttcgaacttgaactgcttgtaaggttcgaacttctcagactgatcccagccaggggcgtactcagggaacttcagaggaggattatggctcttggggccattagcggtgtccttgtcgccagtagctcggaaggtggaagcgtcaatagcctggattcggtaagctgtttgggtagacattgttgcgatgtggatgaatgaaactaaccgtttagaaacgaaacgatacagaccttgctgtccacggtttatatataccctacgtgaattgacccgtggcttatcacgcaatccccatttcagacactcactcactcctccgctatttccatgtggcttgaagctagccgaactttgtgcttgggtgtggcttttgcgtggcgagaagtgtcatgggcacgggtggcttattccgatgaatgcgagcctttgagctagcttctcccttctttgcgagtttttttcggctgcttttttctctccatagttgtgtttttgtccagcccgcagccgcctatcccccgcttaccaataccccagctcttatccgtcatggcaccatcgagagtgcagattgcatgcatcatcctgtcgccacatgcatttgcccaccgtggctagggtttgaatacgtgattgtggctgtcgcgggaagccccatcccgaaagggacgatctgaatattgcgcgagtgtggggtctggggtagccacatgaattgttcggcgttttggtgtgttgtgtatggtgttgtgtatgactagcgatttttttaacagtagctactgtacatggcgcacacagctgaacgcgccgtgcagctttgttaccagcttagtcaccgtctacacagaacgaatcacttgcgtcgtatatttcacgtgtattcatttggagctgttaccatgttgggtttctccaaaattcattgtctcaaattgctaatctgattgcgaatctgagcttgtggctgtggcttggacatggggctgtgggctgatgttgggtaacagagagatctctatgatcgtaaccgtcgtaacagtctttaatactgcttcaaatgtcacttctactcattggagcagaattatggtcttttgtgtgtggtgatgctgtgtcctaagactctcaatttgataatgcaagagtggaagtaatagctaccaatagtagcttatttgcctagagacctgagatgacacaatagctacagtgcaaggtagctactgaaatactgtagtgtgtctgtcaaaagatgattcaaggtgagtgtccaatcagcgtttcagctacctgtactccactccaccagctcagcttctcgctgtactctaaagcggctactcatactcgtgcttagatgtacaacaaaggaagacgcagattacacctgtccatggataatcgaaacgactgaaaaggttatttacttggtgaatattctcgggtgacttattctttttgacgtatggcgtcaacaacgaggtcttcagcgacatttattttgggagacatgtaaaacgggaggttggttctatctacctgaaggtacactcattcagttcgagtgatgtttaacggtagcattctcattgagagtcttcagtaacatatatattctgtctctcttcgtggttccaatttttcagcattatttcacgttaaaacctctttgacatgcatgcccttcccccagatgtggtcatcaaaaaaaaaaaaaaaacatctgattccagcacacaattcaacacaggaaaatcactccacaggaatcggactccgaaagataccgtgctaatcttgagacaaccaaactcactctgaccagagtacaagtggtttctatggagaacttgtatcgagatgcaaataagattcggaagtgccttatctaaactctttttatattccagtctgagactgtctctcaagagtgaaggcttagttgcgaattgtattccctttactgatacttcctaaccaaaatcaactgtgagctgttcaccagttaatgtaagtcgccattcttcacccaagggtgtcacggggttgtttccgtcaatacccacactcgatcaataaaatgcgtatctttctatgaagagcttacgtccaagatcaccatgatacttgtaccactttctctgttctgagtcatggaaaaacatcttggattaactatattatgtaataggtcatctgtgactggggaaaaaaagaaccagcaaaaagaaaagaaggaataaattaaagcaatagagctgggatcataacagcataaacagctctgtaatcgactgcgctggctccgttgtgtttcttgacatgagcgggtggagcagctgtttgagcattcccgagccaggtctgggatgtgggcttcacaggagttccagtgcctgtagtgtcgacgctaacttccaaagtcgaagtcgtggtaggtagagggttgtctgagaactgagttgtgagtgtgtggatatcaaagcctggaacgagccatgcgctgttgatggaggtgtagaagttgaagcccgagacagtgttgaaatacttgtcaatgagcgacagcatttcgtctctcactgtcatgatgccgtctctgttgtcagatgacatagttttgaggtccgctctaatggacttgtattcagggtcgttttgcatagagactccagcattttcgtatgcattgtggtcgatgatctctccgtcgagacttcggttgatctggccagaccctgtaccatactttggttctgctgaggtcgtgtgtttggctgcgagggcgagtgatagttgtagagcgagtgcgaggagattgaccatcttgagatactcaagcgtccatgcatgtgtaccacacacacatatatatatatatatgtgtgtatatgcccggatagtgattcggtagtcccagctatttttacacgttaagttggctacagggggaagcttggaagttatcgttacacggacgaaaagcccagattatagatgaccagattaaaatatttgttgcccaactacattctccgtggtcctgtttccccccctgaattcccattgtatcgttcaccactggccatgttgagcctggaagactattttgggcacccaatacagtttcaattaatgcaccgtatttaggtcgccatgcgggggttggtttttcagccacccccctacggccttataagtggtatttctgtgtcgagtaacttttcggaatggtccgttatcatataataattgatctacgttggaaaatgaacacattcttctctcggaccccttctaggacatccccgttgtaccagcaccactactcggagttagtcttttaatctcaaccgtatttttggcctccccccttacatgatgaccattcagcctatggggttgctccagaacaagaggagttatagccggatacggtcatctggtgatatttgaagatagccgacacccgtgaattattccagtggtccgcgtcaccttaggcttatcctctaaacgagagggaacaagacaggcctggagatcgggtcgaaccgtcgctggcctattgtctgacaaattaaaagtcgaatctagacgctcaattgaagacaccaatgttatccttctaccaaaaccacccaaactgccggctaccaagcgcactgtacagcatgtgtggcacctaccctaccagcccgctgatctgcaggcgggggtatgtacatactgtactcgtaggatgaatagtcagtgaaattgagcatcagctatatgtgacggccatagctcatgctacttatagcatgaatacatacttgttgtagaggcaattgcggagtagcgtgagaaaaacaaattctgctcccattatacgctgtatcgtgttgcgtcaccaatttcattgttcgtattcgtgtcatcaagcacaattggtggcttcaggggtatgatgtttggacaacacctatatcatagtctgatgcttgcgagtttcctgtgcttcctgagctgctacttgttaatcgaggtcacatggtagatatcatgtaactagcgaactggtggaaaaatattgtctcataataattaagcgaaaggatgtgaaatatcatcagaaaccccagatgtcattaagcgtgcatgcaggttagccatggcacatggttgaaatatatataggttgaggttgatggtatgagttgggtttctggatgatttatagaggaagacgaaattggacgtcatggtgtagcgacttccattaatcaagcttttgacaaggaggtcatccaaagggatatctacaaataagtacccatcactcgaagttgtatcgaatatactctagtggttcgcagctactgtacgccccaatgacttttggtcacgatctccaagtcacatgagatagccaatggaatcactctgaggctgtttcaagttcagtgcatggtagaacctcaagaacagtagaatcaatgagttccctggctcttatctgcagaacctcaggaatgagctatccaccctattgacatgaccaaaaaaggtctgatcatcagagtccaacggatacagccccaaaatgggtttccatatatacatggcagagctgggactacaactgaatcccaaaccagtacattcctttacaacacctatcactactatcacaatgtctcccccacgacccgttctccgaggtgatcctaacttcaaggttactcctattccaggtacgtagtatgcatttctacccttcagtacaccataacaacacattctaacgcaggtaaaccaaccattgcggttgagcagatttgcgtaatcgcttgattgacccgatatcatatagataatgcaattataactctcagctaaatttagatatttttcttcttttttctcgctaattcaagtcattatgacaatattaagcgtaattcaaaataattgcttcgtttttgattctagggaaggtgttgttttattctaataatcctggtcattggcgttcaacgaatcatacacatgataatcgtttcgggcgcgcgtgtcatttttttttattataatgatccatttttatatatttctatttcagagaaattttgatgactaagtaaaaaaaattaatttttctaatgattcattacagctatatacctacagtagtagttattgaagatcataagtattattgatgtgatatagttaattaacaacttacaacccacttctagggacacgacgttccgatagtagcacacaccagaagggtgtgtgcttgctcattcaccagaaaagatattctagatcagtggataaaactatctacaggatggacatctcgtctacgacccagctggttcctctcatcactatgtggtgacatctcatcattatgtgaggaattagccaggtattaccccaccgggtattaccttcaacagtagtaagccgggttattggcgttcaataaatcatacacttctgaatcattgcggtgtgcgctgcgaggcgcatgtcaattggtttgtcgacgcttcgtctagttcttttccttgtcgtggtctcgtggtagtgaaccatggctaacagataaagtaatcatatcaatcgttccatgtcttatccagactcgaggttggtttagtttgttgtcataaagattgtagaaggtgtaattcggatagggatcgtgaatatcattcgtgtgtgatttttttttctaatgattatttttattctaatttcatgactaatcataacaccttatgactaacttctgaatcgttacaattttgttagggatcagcggctaagaaatagccgcctgattagtctctcatgaaccgctagcggagtcccggcaggataccgcggagactacgacgaggggccaccacgtgggccctcagtgggattacgctatcattaatatcgatatgccaagcctgctatcacggacaaagggttgcgccgcaacccaggataacatataaacccctgtattccatctattctaatacacctttcttgagagtgacggcagtgaccataccttcggtatggctaccgcggctgagtcatcagtctgcttagtcacagtgcctgggttctaacaaatttaagatttgacttcgtggccaagttggttaaggcgtacgactgttagtcacctgaatggccgccatcgtaagatcgagagttcgaccctctccgaggtcgtcaaatcattttttgtttctctgggttgaaacgaagttttgttttttttggaattggtaacaataaggctgtctgatgctttcaggttgtttttattgtcactttgacatcatgtggcttatgacagctgttttaagaatccaaacacaactggttcacttagtatgttactccgtaaagctatctcgtgcactattgaagcggcctctcagatgatacttgaagccataaactacgcgtgagctactcattccatctacatgtctgtcattcaaccgtactattcatatatacactatttacattactccttctggagctgttgggtctggtcagcctccttttcctgagccacctcctcggcatcaaactccttgagcatctcctgcactcgggcctctacggcctcgttggagacctcatccacctccatggcgtccagctggtccagagactcgggcagaccttcgtgggtgaacagcttggccttcataccgacaccagccagcttgttttgcgagaggaactgcaccaacacctgaatggtatcctgggatgcgttgttgagaatgagctttcggccgtgggttcgtcgctcgaagttttccttggactttgcatgcacgaaaactgctcggttcacagtccatcgcttgaatcgggtcttttggggcacaggtccctcaacggggattcgcaggtagtaggccgctcgctgggcaaactcggtgaagacctctaggtcctcgtgaaagtatgcgttgaagaggagctcggcacacttgaccttaggggtgccctcgggaatcttgaccttgagaggtccgtagtagttggcgagagcagaaattggcagaggtctctcagagttggcctcgtagatcttgtgctcggtctgggtgtaggtgccctgcttggggaccagcagatcatcagacagctgctgtcgaagggcctgggccttgggggtcaactgggactccactgaggcctgggacatcttgcctagctcattttgtcggaaagtggagttgaatcgcacaagcgccgttcgcggcagtgttcgtggggccagggtccgaagaggaatcatcgtgtgctgtgtcggtgtggtttgatgcgaaatttcaccacacctgagtgtcggttaagtttttcagggttaggtctggttgggacaattatgtaatgggggatgggatgggagagagagtaggcgggaggcggtacaataggcaaagggtgttctatttattgtgcagtaattgtctgtctattggtattggtagtacatgtgatattgtggtgtttaatccgtggatctggtttttcattcgttgggttttggaagagtcagtgtccgagatgtggaatgtcgtcaacgaaacttgatggcgctaagtaataagatatgctagttgatgattagttaaaggaccgggcgactggctgattcataaatttattgcccacggcggctatattaacacaaactgctacagtagatggcagggcaaaggtttgcattatattccaacgccgatggatgcaacacaatcctaactaacagaagatgtgtcgagtggcgatgtgggcatagatgtgagtggcgtataccctgaaaccaaacacgtgtttagaagacaagtgtgaggaggaggaaatacgggcggtcttgattgtttaattgggtaggtatgctctcaaattatttctcacacgttatacacaagctaacatcttcattacttcagctactgtccggtaacggagaagtctcactggttggtcagctttcaaatgatccaaaactttggttcaccctcctactcgtagtacacttgcttgaacttttatggtaatatatacagtacaataaatcagagttgaggtctgtgttgatatatgctaccaaaaatggcaaaatgtgcaaatgatacattgtaaaggtcataatccgacgtttttccactttgtatgactagcccctgtcacttttaaccacctctcaccatagcctccactgcgcctgccggacatgccatcgcccaaagtctaactccacatcgcagtgcataaacacgctgatagtgatccacacctatccacacccccaacatgtccgagtaccgacgccaggcgcactcgaaatacaaaatgcccgggggtctgctgcctccggtgaacctcggcgagggttctgggcctacgcacgccaattcgggcttgcgcacagactccaaaatggcttcatttgttgcagtgcctgaccgaaaggccacctcctcgcccttcagacactcggggcagttcagcaactcattcacctcgcttgctagcctcaaagatcttagcgaccgagatctcccggtcaaagccagccctcgcaacaataatagccatggcaccaacaacagtaacaacagtaacaacagtagcagcaacaacagcgccaaggatgtgtctatccccacgacacccagatccagctctcccgctacagccgctctgtcaccagtagacgaaatgaacagtcccaagagccctaccgaagcggcatattcgtccggtcaaacgccgccttatttgagaaacatgaccatgaaacgacggaacaacagcaagtcggccacaccgcctccttcgactcctggactgcttggacgagcaggagacaatggcaaaaagagcaaggacgagattcaggcatccccacggtttctggatgtcaacaatagtcagtggagagaagccgccacaagccacaactccacagctaacctgggacccaactcgaattccaactccacaactggaatgcctccccgatcagcctcgtcatggatgatgagcaacacccccattgcacccatagcactcatgggccacgctggtttgagaaacggacaaggtggaaacaagggaggccgcgcattcgatctaggagacgtcctgtctagagacgacgactcggatagtagcagcagtcgcagtgttagtcgaagccgcagcgtcagccatgatcctgacgaacgaagtggtcgtgctagctcgccttcatgcatggatgattgggacggtgataacaggcttaacatgctcatggctatcactggtgacattcctcagacacccatgagtgctggaggaggtttctcagacgactttactaatgattcacctggaagccctccaatgagtgctggcggcgctggctggatgggccaccaaggagaagatgtggacgccctgggcatcctggaaaaactggatcctgcccctacgttggttgactacactgctctaatcgatgattatggtgatctagggtctcaggacgtgcgaaagcaaaaaatcaaggagttcaaacgcaaactccaggaacgcgctcagcaagatagcgagccagttgcaaagtctatctctgtggtggacgccactcagcatatgaaatccaacctcatcagtaacgtcggtgctcagatcggatctgttgaaactcgactttctaagaagctggaactctttcaagccaatctcgaggccctcattgatctcaaggctcgagccaaagaaacagtgttagcattcaagaaggagacgcttacatcttatgagacgttcaactcacaactggaccatattcgtgccatccaggagtcgtctgaagccatcgaactgctagaagagcgaattggaaattgtagagctaaagtgacggagtacaaggaacgtctcaagacggtaaaccagtggattgatgaacaggaacggtttgatcgactctggtctcgacgtaagcgagccgccttcaagattactgtgtctgtgcttgttgtgatcctgctcatctcctcactggttctctttgttgctacattgagaggaggtttcggtaagagtctgaagcttggattcaaaaaggcgaaaggaagcactgtgacactttccaaacagagtcagtttgatgatgttttgcagtgccttggtgactttgaccattgtcgtttcaagaatgacatgaaggaattgtaggcatatagatttatttattcatttacttagaagattgaatgtagactggagtccatctgtaaagatgcgagttacatgttcgtgcaagtatcgacaagtccaccaagcttcacagtaggatgctagtgaacgactccatatacacatgtattggtactgtacatactgtgtgtgtagctttagtatgtacttgtaatacattatggtactcgtacatttgtgtccagactaaaacctgtggcgctcaaatgaagacagtcaatcctaatggaaactgatccgtccgaaactaataaatatatatattggtccacttattctgtgtcacacttcgagtcatgtagtgtggtatcgtagcaatgggggaagaggactcattgttgatcctgaggagtcttcacgggtgtgagtatcggtacaagtatcagctgatgtaaaaagaaacgtcttcgagatgcaaaaggaaagcccgacgtggggcttgaacccacagccttgagatgactttagaaataagagtctcacgctctaccgattgagctagccaggccagattgttgagccgggagagcggataaccgttttgaatggcaaaatatctcacgtgtgtcattagaataaaaaagtgcatcattagaatataaaaaattggtacaaaaaatgtgaacaaaaaaaatgtgaataaaaaatttaaaaaaaaccatgtatttccctacaagtagaataataaaaaagctctagaatcaatttatttttttaaaaacaaaaatttttaaaaaaaaccgaactcgaatcatgtgcaaaagaaagaaaaaaaatcccaatgaggatgaaaaaggacggaagctgtgctaaagatggtgaagctgcagtaggaagcattcgaaatacgctgtagtatgtgcatacgtgatcttttcagctttctcataaagcgatatgttgggctctatgaatgctcccctgtggtctcgagcgcgagtcttctcaaccgagaagtgagagagaactgttaaattacaattaaatatgcataaactatcaactatcatcaaaattcctacccctagttggcactgatgagaacgtacttggtaatggattcgaatctctcagccgtcagcttcagaaccactttcagaagctcgttggcaagcacctgtccatcaggctcgagctgctggagctgcttccacgactcggcatccatcttccaaacagtggtctccacctctgctgtgacagttgctgttctataagtctcggagaagaacggcagttctccacatgtggtaccagccagaatcgtctcgtaaagtcgaccctgctgcatgtcgtagtctgctctcagaataccgctttgtacaaggtagaatccggtgggagattggttggcagtgtacagaacgtgacccttgggaagcacctccttcttgaagaatgcgcagattcggaaccaaaagtcctcgttctcattggtaagaccctgggacacctgaagcagtagaggcaacggctgcttgaagttgttccacttcattatagggtcgtctttgacgttgttagtggcagcccgatggatcatgctcagtcggggagatgcagagtagccaggagatgaagaaagcacagcaagcgcattcttacggttaccagaagtattggtagggatatcagtgggtgtgcctggagtggtaggagaggcagcatcgtcgcgggcactgtagtagagactcaagaactcattctcgcaccattctagggcctcgttcaagttagagaacagccgaacatcagttccctgcgtgcaagaacccttccaaaggccaactgcacccaaagcggatgagatgggagagttggatccaataccagacatgactaggtaaacgttcttgctatccagcagctttttgatacggatgaacgcctcggcagcagagaagtcgatgttagaaacggcagtcatatccagaatgaggtatcggaaaggagactccttgaattgtgcgtcatccatgagctgcttgatggtatcctccacacgcacaatggtaccgaagaacatgtatccagaaagcttgagcaggtagatgaggttaccacactcctgaagaaacttctgttgggtagcgtgacgtcgaacggtggatcgagccacggctccagtgtatgtagccttgatgaccgatctctgagaagattggataacaaatgagaagcatgccaacacaataccaaacagaataccgtagacaaagtcgaaaatacccatggtgagcacaattgccaacacagtgatatactcgaaccgagacagtcggccccaagtgtcacccagagcttcaatcagaagctcaatgcccagcaagaaaatgagggcaccaactacacagacggggatgaaaccaatgactacaggaccggcgaacataacaccagccgtagcaatggcgagcatgacaccagccactcgagaatcggctccagacttgatgaacaagaccgagttagtgtagaccaggtagttttgaatggatcccatcagaccactgagaccgttactgatgccgtgagcaagcagttctctatccacgttgatgtcctcttgtccagtggaaacagcgagagcaggcacgttgatgggaacatgcagaataccgaagaaggtcagggcgaacatggcaggcacggttttcaacagagcggcccagtctgtctttccaaagtcgtagagagtgtagtagtaccaccagggctcgctagtggcctgggcagagaacacccagccattatctcgagccatttgcaggttccatgaaggaatagcccacaccagcagatggaagatggcaaaaacaccgcagaagtatgagggcacaatcagtggatggtgagagaatcgttggatgagaagcagggctaatgcgagggccaaaggagtgctccacatgagaaggatttgggggtccagcagaaacttgagaattgcaaatgtgtattccaggggaccgtccattcgggaggacacctcaatacccgttacgcacaggaaccatcctacacctccaatgcatcccacaagaatatgacgagggaagaaggaaatgagtgatcctagacgggcagctcccagcgccagaaacaccagcccggttacgacagaggaggttgcaaacgcgagaataacagtagggatcacccgctctggctccttgatctcggccattagggtgtatgccatggaatggaaaaagggcacgacctcaatcatttcggatccaataccagccttgaaagcagatcctcccagtgagtagaccaattgcgaaacgacacaactcatgtagaacattgacagacctgcaggacccagatgtgcaaaaatgggctctgatagcgggaacagaatcattccgtacgacagaccgtccaagatgttgaggagagttcccagcactactgagggcaggtatgatattggcttcttgatgcactcgtcgagcatgtctgctgatgaggtatttttgatcttttcctccagtctcttgaaccatccgctgagtcctcgtcttggtcctccatggttcacgtcgccagtttcgatgtcgggacatccaaacgtgtggtattgtcggtgtgagtctcttctggacgctgtgatggtcgattgtgctgatttctttgattcggctgacttctttggccgtagcggatctcgctctgtgttgctcagcccgggagtttcgatcacatctggaatcggtagcggttcgttggctagctgtcgagacagagaggagccgtgcatagagtagctctgtgctgatccggaggatttgggacggtcgttgttagatggcgaggttcccataccttcttcgagcgccatattggctagctcggcactctggtgtcggaggccttcgttcatgttgggcactgatggtggaatgagaatggacggtcttcgtgagtaggaccgtccgcccaaacgctggagaggcgactcagagaatgaggagcccagatatgagtttggctgctcagacattgtcgcaaaagggatgtcgtcgttgagttgaagctagcgtcctgtgttatctagatggcctcgagaagagagttcgactacaaagtttgagtaaatggagcttgagtctaactatggagtcggtggagatgatggatttctggtgagtggtcgagaataattgggggtggttgaattaatggatcgatataccatttttaaactagtcaaatagttttggtcatgtttccttttatgtaaagcatcacagctaccacgaaaactaacccaggttggttctccccaagcgtggttacactttggggtgtgaaagacaaaattattgatgcaaatacttatcagtcaagacagcctatagataaacaacgaccggaaaattatagctcctaaatgtccaagggattcgtgattcaatagaagagctctttttggcatctcaaaggcatctccacttggaagacacgcctacagtatctacactcacattagtgtctgtgccaacgttgatgatgcatagatcttgtgggctagttgaaatactacaagtagctatttctgggaaatggtggtctcgtatcctacacgcactgtacgcaagagacatgtggcccttggacaaaaggcatcacacggcaactgagacaggagctccaggcacgggctcacacgctaccatatgatatttgaggcagacacagaaagcgtaattctccaggcacgccctcacttttctccccaggtagacagtagacaacggactctctctcactacagtaagcccaaaaacggttaagcctcagccttggtcaaaacgtattgtattgtgcaagacgagagaaatgtttgtcaactctaagacagccacagtaatgggagaaggcggggcggggtattgaaacgcccttgttgtgggattgctcgattcgccgcttatttacctccttcctgcgttttatatctgcgaccaatcgcttaatatcccgtcttttcaccaccaacagggttcaatatctcgtccatacaccacacctgtatggtggtcgcaaagttcacgcccctccaaagttcacactaacgaactctagctaaacgaaacagaagactccaattagttatcccaaagcatagatacgagtgtagcgacgagaaaacaggcacacgaacaagggccatacgctccctcggtatggcttcagatgattagttctagacatctctctccgttagcgccacatgcaaacaaacgccgatcgtcgtcctcctttcatttgccccatcttcaacaatgtaacttagacagctctcacccaatcatattctgcatacagataaggaaaaaccacacacccatgtacggtgataaaagaagttattattaccagtactcgtgctcgtaccctgacacactcagtttagtacttgtacccggtacagtagcttacacaagtacggtagatgcaatgttggagtaaatttgtacttatacgaataacatgtaacagtacatacaagtacgcttggaatgtaatagccaacatgaaataaccatgcttccccaaccaatacagacaatatcacaactcccatgtctttctatcagacttacacctgtgaaaatattctcccattcgtataataatacatcagtatgtatctactgtatcttgtcattgaaggaaaaaacatctaatatacagtatctatatacctagctatgttttcatgttctcaatccgactaacctttataggcattgctggttcatcattcataatacaatacattaataaataaatttcctcctccgatctagtcggtacacctattctgttccctcggtaggcattatatggctgttgagtgaggcaaacattttttcaatttcctgagagccctttgtgaactccaggtcccagaaccggtaactggggttcttgagcagctcagcaaaagtgatcatcagaccccaaggatgaggccggttgcagatgattcgctcaagcagcacccgagtgataatgtgctgaatgtctaccttgccggaacccaggctggcctcgccatgagcgccaaagagcgacagaatcacacaagagtaccagtaggtgtgtctgttggggtaccgcagctggttggcaatggcctcgaacaagaagtatcgtccctcggcgtccaaagccactgccacagatgtcagcagagacaggtggggcgaagaagtatcaaaagtagcggtggagatcaacgaggcaatgtacagcaccagagcattgagagcagtggaatccacggagatctcgttgaaaccaagacccaggcaaggcttggcagaaggcagatagaaggccttgagtaggttcttgatgatggcaggcgacgggtttctcagatacatgtcggtgagctttcggatgccatgcttctgggcctcgtggccagggtcaatagccagaggaggggccgccttgatctcagccagcgattcgaccttgagaccaactgtgagagggtcgggcagctcgagatcggcagggaaagctgacaacacgaggtttcgcaactggatgaacgagggcgaaatcacattgcacagcgggtagtggttctcgatgaggaactgggggtagtcgtggaggatcaccagcataattcgaagagtacccttgtacatgacagccacgtgctcgttgaactccttgtcggtggtgaagtggtcctggaacttgagtagggcctccagcagagatagataagggccccagcctcgtcgatttctgaccacgtccatcatcttgggcaggaacattcgatgcgagatcagagtcatccaggcaaatgcaaagccagggaaagccatgggttggatgagcttgaacgtctctgcaaggcacaagtagatggcgtctcgagactcggcgctcagctcagcctcgcttagctcgcaaagaatggacgagaaaagtctgaaataaggcttctcgttaaatccgacgggagactcgcctccggacttggcctcatgatcaccagcaaataccagcaccaccacagccagcagctgtcgcacaaaggcgctgatccgcttggcgttggttgcctcgtgggcagaaataatggtcactagtagtttggccagaccatccacagcaacagcaacatctccaacaggggcagcaggcttgtcaaccatctcaaagcagtacgacttgacagagatctcggttgcagtccgcacaagcacacagaggtggtcagggttggatagcataccgatctcagaaagctgtaaaacaaacatgtaccgcattcgcagattgttacaggctccagggtggcccacaagtcgcagccactcagcaaagatgtaggcacactgctccttaagagacacctgggaggcgtcagttcgagaagcacgagtggactcagacagctctgtgatggtgggaatcaccacgttggtgtcgttaagagttgtgatgcacttggcagcctctgtggcagcagccgcaagcttttccttgttctcggcctccttggcctccttggctttcttctcctcctcggacaactcgggttcgacctccttaccttcttccttggtctttgcttcctccttggactcatccttgccctccttgttctctttgatgagagcctcaaggacaatcagacaacaagagaagtcggttcgcagagcacagggatctgcgccaagtaccacgtcagcaatgagtttgtgagtgaactcgacagcagctacatcccgcgactcaagcatctgcttggccagagactgatccagctcggtgacagtgatgaaccgagtccgcagcaaagtggcaaccacaggcacgttaaacttccgcttgtcagaagagtggatgagccaaagcagtacctccttgcaggtctcagcagaaagctcgcacagcttacccagaagcagagcaaatgactcatgtgagagctgggagtcggactgggtgaacagagcgttgaccactagctgagaggttcgcagtacaacctcgttctggtagggactcttgctcaccagagacagaagctgcagcagacgaactcgaatctcgtggtcagcgggaagttccactagagaggtggggacggggcctgcagatccatcggtcacagcgctaatgcttcgcagcagagcgtcgattcgagcctgaacagtcagcagaatctgcgacagcacagcctgaggtgtctcgggggtggaaggagcaggcacgccggcagcagctccttgaccaccaggaccagcaaccgcagccattgcagcaggaacgctgggcaatccagctccgccctcactgaaagagtcgtagagcgccatctgctgaggagtgacaccaccgggctggattcgcagaggatctggcaggggcaggttgaaccgagttacctgggggtccacaaacgaggcagcgtcaccctgatgagcctgtcgcagagcgtaagaggcagcaagggcctcttcaatgtccagcagcgacttgtcaatagcagccttctccacaacgcagcagatggcgtcagcgttggcagccacggcagcggccatctggtctagaggaagggtctcctctccatagccctggcccagcaggagggtcttgaggttgttgagcagggagtccttaagaggctccttggaggtgaccagagacagcgatccagacagcattcgaaccacattgtgggcggctcgtcgcagcttgtcgcaatctacctcaaatgcaaaatccttggtaaccaactcccgggtggcaatggtggcaatagacaccgatcgttccaccacgggttggagcacctctcgaacggccttgtcaactgacagcatgaacagctgtttgagagttgggtgcgacacaaacggagagtcgccctgaagctccatcgacataatgatgttctggtaggcatcgtaaaaagcggcagaggcaactgcggctccagcggctctcattccaacgccaggggccccaccttgctgctgaacctgagcctgagcctgggcctgctgctgagcctgctgctgctgagcctgctgttgctgttgctgctggttgacaccaggagggccgtgaatagggggcatgccaggacccataccaagaggacccatgcctccgggaccaccagggcccatcatgccaccaggaccacccatgccaccaggcatgtgcatgcctcgaggaggaggcatgcctgcatgcatgcccatggcgccagggggaaccatgccggcgttggcagcatcaacattaagcttgctgacaccgtcaacaacctcgtcaacggcagaagagccacctcgaataatgtggctctgctccagctcttcaacattgagcttgagctggttgcacaatacctcgatctcaaacttgaggttcagcttgagctcggcgtgatggtacagctctgcaagtacgtgcatgatacccagtgtccaggggtttgggggagcaaacaccttagacttggcggcccgctccagcaccttggccacaaaaggaatcaccagtaccagcttctgatgcttgtagccctctgccagcagcgccttgaacgaaatgtttcggtgcttgatgggcaggtttcggcctagagtcagagctccgagccactggcccaggttacgaagctggtttcggtccgtggaagaagagaccgtctcggggctgttgagaagcttgacaatctgcaggtaggtcacccgcaggaagaagctctcaagcagtttgtttgacatgttcttgagcatggaaatgtacagggagtggtagttgggctcctgctttgcacgatgtcgcacaatgtaggtagcaaaccatcggaagtaccgctcctctagcacctgggccatctctcgagaccgagcaactacattgctctgagcaaggttgttgaccatgaacagcaccttgtcagacaactcctctgggggctccacctgcgcagcatcctcaggcaagttggagtcgactcgaatagatgagaagatgagggtctcgggggcgagagagttgtcaggtccgccagggacaccaggaggaggtccaccaacaccaggtcctccaggtccacccccgggtccgccagcaagctgcttcacgtaagagtaaatttcctggtgagactgcagacctgggatctcagcaagaatggagcagtaggtggggaattcgttgagccgctccctgaactcgtagagtgcctgcaaaccaaacttgaacatgttggaatcggcgggctgcttcaaactatccagcacgtatcgcagtgcaatggacagagggatgtcctggatgagccggaagtaaatgaggccaccaaacaggacggcagtagcagcaagggcgtttcgagggtactcggggaagaatcgatactcgtcaaacagcgaatggaccatgcatgcaaacacgtcctggtcctggggatcgtcgctctgcttgagccgctgcagcatagtgatgatgtcgcggatctgaatctgctcctcgtacattcgctggtaacacagcttcatctcccgctcaatgtgaggagggaaggcgttcgagccgtcgccgtgggccagaatggcttggtcgtgaccctggccaaagttgatgaggcgagggtacacttggaaggtctgggtctgcagcatcttgaactgctccagtcggtcggcaggcatatcggagcccgaggacacaaactgtagaatggtggccacagagctgagagtgagggggttctgaggaggaggagggggaggaacaccgacaccggcctgggaagatagctcgacgctaatcttcatttccaaaaagtccaacacgccccgcacaaagtcggctcccacggccttgtatgtatcgtccataaactgtttgagtggatacagctggcgctgggaggccagcaccgccagatccatggtgaaggcaaagtatcgcagctgcaacacatggggcagaatgttggcggcgtggcaaatgtctagaatcttgcccacgttgagagcactcacccggtagtactccacaaccatggatgccaggaaggcctcgtcctgctggcccaaaatagagaagaccaggattgaagagttgtgaccggagaagaagagatcaaagaagttcttgatgacacgctccagcagaggtgaccacggcttgggggtcttgagcgagcccagaaagaagagctcgggtgtgaccttggcgtgtttgtcgaggaagtccttggcggccgactcggccacggtctcccgctcaatggcatcgaaagtgagccgcaccagatccaccaggttgaggggggacgcctctagggccaccacgatgggtttcatgggcgaatcagcggcagccatggccggggggatgacggacgaagagatgattttggtgagtccgcatccggcgaggtccagctggtgtcgctctcgcgaaatgccagctgtagcgttcatcaactgcacttgcagagccagtcgttgccatcgacgtcgctgataaaagtatgcaaccagagagccattggggtctccagcaagcagaattcgcagcagaacagcgaggccatcggatgagccaatgttgaaactgttgctattgttgttgttgtcgttgtcctcctcgtctagtccgtcgatggcctccttccatttgttgaggtcaggcagcttggctaccagtcccttgcccacgccgaggccatcccacttggcattttggactccacgcttgagcacctctgtaatgtctgcgggggatagtttgcccgtcaccagctcgttgatgtctgattccgagagatttgtccggttggacaaagatgcaatagtcactgtgttagtcgccgcaaattccttttgtcgtcactgtcgtcgccatcgcatgccatcactatcactcacttgtacacccgacgttatcactgtaatatgggggttcgtgtgctgatctgtatagatgtctgtgtcagtaacgtgtttggaagaaggcatatcgcgggatcggatcggatctgtcatgtgattcatccctcagccatcgcactcacttgtttgtgtcgattaccagcgtgactactcgtagtaaatgtgtcttgatgtctggtttttggtgtgtgtgtagtggtgcggtgaaaaactaaggtgtacttcttctacccaactttgggaggttgggttaggtgatactgtatgatgactatatacggcaggcaggagaatgttagagggttatgaaccggtttttccttgattgagagaatgtgaacttgggggttcatattgaagcggccaaacaatggcgcttactatctgttttcattcaccacagcccatttaatcggatcaaataccaacgcccttgacagggtaactcaagcaaccaaagttaaaacgccactatagaaacacattcgacgatagtctttaacaacaccgtgttcgggaacaccggtaatgtatggtacaagtagcattggatacgacactatgatgccaccattggttgtgatgtgacgtggattgatacgtcaagggtaatattggggtatgacataactcatttaacacgcaatctaccaattgtgtctcttggccaaactttaccgacactctttacagaaatgtccctgttatttacagcagacgatggaaggggtctacacaccttcacaggcttctttctccatattggtgcaccgcatcatgaagcccagccctgtacatgaaccttctttggcgattagatcattatggaggagcaacgttgcataattgcttgttccaggggatattacgtgaacgaaagtgaactgagacaagtgggatagattaaattggttctacttgaaatattcatttgagttccgggtttgcggtcttcttgtactacttaaacgtacactgttagagcttcaccatcagtttttgtaatattctaactagcctctgaaatccatcagaagagagacagaaggggaagcagagcaagggctccgagggtggccttgtcggctccgttggcttgggccacagcaggagtggattgctgagcctgggaaggctgaaccacaggaacaataggagttccaggaactgcagatccggctggagaagaggccttgctggcggaaggagtagccttgggggactcagcggcgggagactcgacaggggccttcgaaggcactactggggcaggcttaggggactcgacgggcttggaggactcagcgggcttggaaaaaacctcagcctttggagcagactgggccttagtagtaggagtctcggctgtctcggccttagaggactcaggctgggactctgcaaccttggaaatagtggtgttaatagtagtaacaacctttgtgactgttccctgggcagcgacagtggtagaagggacaggggcagaggcagaggcagaagaggcaggagcagaagaagcggcgacagaggagacatagttgtgctcgcacttatgacagacagtactggtgactgtcttgaggacgtgggttgtcacagtctttccagtctcatcaacagaggtggtgagacagtcagaagtgtagacagtgacgtaggcaccctcaatagtggtggtctgatggacaacagggacaacgttgacaacagaagcagtagaattaaacccagccttggaagactcagtagacttgataacttcttggttggtggcgttagaaggcttctcctgggtgacgttagtgggcttctgaacatcctcaacgacctttccacactggccagcagcgggcttgatgatattggggatatctccctcagtaccccacagcttggcaataggagggaagatggtgtttccgacgaggccaatagcagaggcattgggggcggggatagacactcgctcgtcgttgaagtagccgacaacagacttattattgtactgacctgtggtatcatggtcaacaatagagatgtttagagagtcagcaacaagtttgaaggggttagcaacggtatcgaatcgcccgagatggtccagtccccagtttgcctggacagtggcaatgttagagtaatgagagtagtaggtgctgtcggtggtacccttgaggtggtcagggacggctccgccaaagaggatagcaagtaccttgttctccagaggcttggtgtggttctcgtcaaacgtaaggataacaagagagttcttcatgaactcctcgttactgagaaggggcttaagccatcgggccacccatcgtccagcccagtctatatcggtatcgtgggcatcgttggtcatgttaggagtgatgaaggtccattgggggagctccttggccttgaggtctcggtcgaactcggtgaagttcttgatgtttcggagtcgagactcgttctcaacaacactgtcgtagattacgagggggttgtgctttcgcacgtagtccttggcatagtcagtctgtcgggagaagttgaaaccttcaaagccggtgtagggaaggtgttcttggtactcggaccaagagatgcccttggactcaagcagatcaacaacagtgctcacattcgaggggactcggaagaaatcatcgttgttgattccaaagtagtctcctccgacaacgccaacgtagtttggctcggaggggtgagtaagagaccagtagttgtccagggtgattccctgggttcggagccaggcaagatcctcctgctcaaatgccttctcatagtcggtattttcgagccagatctggtagtagttatcaaagaaacatccgggtaccttgggagaggtgtagtggttgctgacagcagtggcagcggcagcctcgatctcggtaagatcgggagagatggtggagaacttgggctggtaggtgttcttgtcctttgccaagacggcagccaccagagctgccagagtgggaagagaaagcttcattattgttttaccgaaaccatggtgtctctgcaattggttatatatgatgcagtgagaaagatattaaatcgatttgagctagaggaatgtaaaagccattcgaatagagttgtccggactccgtgctaaaaagttggtgagcgtttggtgatcaggggcggcgatggaagttggtgatgaacgttggatgttgtgggttccaacaaaacggtttgaaggaatcacagaagtggaatcccattcaagggcatggtaattagaggtggtcgggtcgacagatgtctcttcaatcacatgcttagtcccttaccgctgcttctcgacaaaaaaccagcagccattaggttcaataacaacgaaagtcagccacgggagcctaaaacgaaaactcttgaaggagttgtgatgaaggtcatcttcatgagtggggatgcatgttgccagtgtctatttgagcgataattgtatcagaagcacactcgtatcaccactactttcagtgggattctcagagacattcatagaactcagtagacacaagagcataactggctgtgcccctgggtaaaattatatccgataatgttagaaatacactctttctaattggatggattctaccacacgtgcgtatcaggcacgtgtagattagcctagccgttaaactaatacttagatggttgagatgtcacgcactgcagatgtgattttcggtacgccaagagatcgtctgtgagggtgttcgtcgaacgtgcgccaacgtgattgccagtacaaagaggaaacgacgttagaacaaaccaggaggttgcccagagatcatgggtcggcgcctctttcatcaaccagccgttcaatggtcgcgactcgtccaagggaactcaaacacgtttaggcggattgagaggcatcattagggctgtctcagatgactgcttgtcaattttggcctctaatagtgaaaatgtcagtctaaaaagccgttagagtgggcggtggagacccaagggccattatggactggatcggcaccacgttttaccagtcattgggccaaacggaatgtggagtgcatggtgggactcgcagtgcaggcgggagcttatcttccctctgaaacatggcttgacctcgtccagaatgggaattttaatgaggatgccggccaagacgactaagagctcgtcccgacttggcagggtgctgaagatgcttatctgaatgtttattgagtcattttggacagactgacactgcctgcgcagtggatgcatgaacgaggctcttgtgtgggatgtcgagtcatggaggtcgatgagttgcagtagtcgaatggaatggacattacttggtagctacttgtgcaagtacaattgtacttgtactgtaatatatcaacaaaactgcggatattgtttatttttaaaatgtcaagtaattgctatcagccagaaaaagagtattaaagagaaaaaaggtggactcagtcttatgggggtactcgaactgtagttgatcacctgccgtatatttacgatatattttagtttaatttaatgcataatatgatattattaaaaaagtggaaagaacggcttgaaagcacattgctgcaaggatacaacatccagagtgaccatagagaaaagtataggaccagtcggggcctatatccccatacaagtagtcatatatgaactactctgtgttcaaatatcgacttctcatgtgctttataacatatcaccccctctcgattttctgtcactttattcagtataatgtatataattaaggacacatcgtatggtaatcacgtaatcatactgtatagtacctacagtatcgtactcatactcgtacagtacgtgtacgtgtatatacgagtacaagtattcgtacggtactcgtacactttacaagtaaagatcttttccgagtttcaacagcttgatgttctgttttgattcccagacagacccttgtgacacctatgctgaaaggttgtcctcatccggatgtcaataccagcgacagcacacatgggttggctgcgcagtacagtacaaatgcaatatgcaccgtaccagtgtgatgccgagatgacatatatatattgtggtctttcacgagtccatcaagtgacgtgatcagttcatatattcggtcaacgtacggtgcacgaaatgacgcgcgcgataatcacactttaaacgacaacacagcctcgtcatcagagttcgggatagcttccgggagttttatctattacatcttttgtattcttggcagaaaatgacacaccaacctcaatagccgccatttttagccgcattgagacaagctggggtagcgttaggcagccccgttaggcagccagaagcaaccgccaagccagttgctgtattcaaatatgtcagtcgttagctcgctattgggccctcccaactgaagctcgcccatactttcgttctttgctttacatatgccattctctcacaccaactgtcaaaaattcaaaacttcggaccgcatcatatggtgacactacagtagctgcctgagaatcacgtgtatcgatgtagatatataggttggaagggattttttttaaaggccaaatgggacccaggacaaatacattctccttcataacacgttactctccatcactttgtttgagccggctaatcagttgccatctctaaacctgtttcgtttgcgttttactttgcataacgccatcccaaaacactctctctattgctgaaacttgtcatctacagtaacggcacgacacaatggctctcacaaaacaaccgacgctgtggggagtgccgctcaagctcatttcgctggtgacactgacggcccagaactcgtcgctgattctcgttatgcgatactctcgaatcatgcctgccggacccaacggccactacttcacctcgacagccgtgctgctgaacgagttgctcaagctcgccatctgtctgtgtgtcgccatctacatcactcccggccattccattcaaaccctgtacaaagacgtttttggccccgacgcgtggaagctgtccattccagccgtgctctacaccctgcaaaactcgctgcagtatgtggccgtctccaacctggatgccgccaccttccaggtcacctaccagctcaaaattatcaccactgccttcttctctgtggccctgctgcgacgatcgctcagtaacacacagtggctgtcgctgttcattctcaccattggcgtggctctggtccagctccccgcagcagccgtggaggccattgtcgactccctgcgatggagctggtggtctggcgaggaagccaagaccgtggtcaccaaggttgcccgagacctcgtcactcggggcgctcccacagacaccaactctaaggttggtctggtggccgtcattttggcatgctgcctgtccggcctggcaggagtttacttcgagaaggtactcaagggctcacagacgtcgctatggacccgaaacgtgcagctgtcattcttctccctcatccccgccacccttattggctgctggtggtaccagggagctgagattgctgagtacggcttcttcaatggctacaacaccactgtgtggagcgccatcattcttcaggcccttggaggcattgtggtggctctgtgtgtcaagtttgccgacaacattgccaagaactttgccacctccatctccattctcatctcctttgtggcctccgtgtacctgtttgagatggaggtcacggtcaactttgtggctggagccgctctggttgtgtttgcaaccttcctgtactctcggcctgctcccgtcccccaggagctgcctaagagcaactagacattgacatgtacttaatatagatagagattgtatgaggggcttggtggtgacagtggggagtagagaagacgcagggcgtgttctacgagaaaggggcgccactaatgcaccataccagaggaattccaccagggcaacgacagtgtgagtactcgtaccgtatgtacttgtagctacttttgtttacggtatgtgtttgtctgtttgctcgtgtgatgttgggagcgcgagtctcaattggatatggcttccgtcactacgcgaaactaacacgcagggagggggctggtgtgatacatattaaatggtctgctgcttcgactgaagtatacctttgtaatttgtttccatcactgcattgtcgtatacgtgcacaccagaattaaacgactgcctggaatgtggtttggaccttaaacccgttttagtgcagtattgtacaagctaccccgtaaagtctcacacagccttcggctctgaggtgtcacatacccatgctttggtgtgtgatgttcatgaattaaaaaaaaaaaaaaaaaaaggtgtggttgttatggtgcagagttggtttgagagcatgtctttatattctgacaactccctgtgtccgttactagtaatccttgttgaatagccagtttgctctctctctccaagtacttgtacttgtagctctgaagatcatgtttcagaagtacaagtacaagtatgtgaatactatgtttcttggtgttcttatttagcgttcatcttacagctcttatttagacaacatatatatttgtaaatttagtcatccctgtaggcattttttacttgtgcttgtgcttatacaatagcttttaccctcattaatgtacaagtacaagaattcctgtctttccaattaccaatatcaccagtcaccactcgatagaaccacgtaaccattgaacacgtccacaatccctcctttccacccatttatccaacaccacccagaatcgaacccacgtccccccattaaacagtccgggacatgcaggcttcgggcacgtcgtcgaggctaattaagctctggtccgggtaacaccaccttttctttatcaccaaacctgggttaggccgtttgatgcagaccaagaacccgaccatcttttgattcagaccgcgccaaatatggagtaccaagaaggattcgcctcgcgcgagtacgacaacggacttgtataccaattgcccaacgcacagcaagtcccacgccagcagccaggtggcccacagcttcaacaacagcaccattcgccgggagacactcctccacagatggtgacaaagtaccatacacaaatcgacgtcgcggctgcggcagcagcagccgcggcctctgagccggaccccgagcccgagacggagcagccgttctacgtcaacgccaagcaataccaccgaatactgaaacgacgagtggctcgagccaagctggaagagagcctgaaggtggcacgcggccgaaagccgtatctgcacgagtcgcgacacaaacatgccatgcggcgaccccgaggccagggtggccggttcctgactgctgcagagattgcagagaaggagagacaggaggctgaggaagcccaggcacagggagagaacaagtgacgagaaaagcggacgttccggttaccacacactaacggttggagtttgaagccatgaaaaaccacctttttatatgtaatattgtactacttagtgatgaatgatgattaatgattaacttgatggcgtagagggtacacgaagtatatcgaggggaggtagttaaaggtgcaggccagcacttcgagttcacagaatgacgattctaataggtgcttcgagcccatcgcttttctttttatcgtatgtctcaaactaattatatgtggaatatcacttcatgcacgtgagatttacaacttcatggaaatacgagctacgcttccaagtgcgatcagtcattctataatctaagcaaaaagtaagtcgctctgtgtcttctcttcaggctggacgtcgactttggcagagtacttgggcataaataccgactcgaacctagggcacacagtgaatagcgaagaagggccagagaagactcttgttagcttctctcgcgactggaacagaaccaactgtgtgtttgaggtgttctcgcccatctcgctcacaaattctgtcccaataagttcagcaagttcagaatacatgtccccaatgattttgtcaaaggtgccggcttcatgcatagacaacgcgatttggagcacaaatttgcactcatcaatggtcttgtgagaacacttctccagctcagtcagaatcttggaatgcaacccagccagacaggttgtgatgaactcctcactggtggtatactccttctccagaagagccacatgcttcgaggtccactcatcatcctcatcatcaccttcatcgtcatcatccagtgatcccttgacctttacaaacacctcctttagactgccgaggacagctcggatcttggccacgttctgcaacacctgttcatactgagacacaatagtgaatgcagatgatccggtgaccttgttccgagtgtcgagaatgcccataacatcgatcttggacgacttgcctgctcccacaagagtaagagcgttcacaagcggcgaatcaaacgaaatgatagcctccagagacaccttgtcctttatcttgttcttgaaaagcccaaagtcaacctctccgaggtttgccttgatcagttcatgaaatttggtcttccatgcttgcaaaaacttgtcgatgttaaaaacggagccgaaatcagcattccgcagatctcgagactttcggaagagcccaaatacgtcccttagaaggtcaatcaaaccctccagcgtatcacgagacttgatggaatcggtagatgcacgatccaaaacaggtcccatctggtcacggcaatactcctgcagaagatcaatgatgcgtttaggaaacttgtcatcacgggaatacttgcttcgagaaggaatagacgctgcctcagcaacttgtctcggtaaggtgtcccagttaagcaacagagcaatgttctgtttgcgtagctctgtcttgagggtctcacatagtgtgccttcactggaaaattgggcagattccagctgatatagaatagaagacttcaaggaagcagacgccaggtacttggaggcaaacttgagtgtgtatgaaatactggtgagagctttggttaagctcttctgttcaagtccttcgaatcggagcttcaaaagatcttcaaacgcgtcctccacagacacagagaaaaaaatgcaataggagagaagatcactaggcgagatttctccactgagacagtttataagtagcttgcggtacttggacttgagaaagtcacgtggtttgtttgagccgtccagcgagtggagatagaacagtcttgccatgagcaggttggattgttcaattctggagtctgcgaagaaaagcaattttcgcagaatcgactcgatggcagatttgtccagttgagcctcgtttgctttcgtctcctttacccatctttctagacttttgtcacatacagccagttcctgtttgatatctccatggctcagattactcaaaagtgtgtgttgtttggtcattttttcgctcagagattgaatgtcgtctgtagtacccaataaatcacggtacgtggtgtttatcagacatctcaattcctcatttcggcgatcctttttgcttcgaagctgctgctcaatgatgaccacgtctgcgatcgagtacttggacattgtggactgccacgacgacaatcccaaggccatataatcgtctgcagacgtcgcattacggatcttgagagctagagccgagtttgctggcggctgttgcatttcaggtcgtgaattagtggtggtagggatacgtggtgttgtgcatggtcatatgcatgctggataaaccctaacctgggcggtgtagcttggggtgaaattgtggtgaaatcgaaggtaaggagcatgtgattgacagttgtggctatttatcattattgtatcattaacctgtacaacgaccttcatgtgaagttgcgggaaacgggaagagtcattactgtgatcagcattgacatttcttccatgcttcagcagcaatcccaaacaaactatttcaaagctaactaattccaactaaaaatctaccaccccatggataaaacagatctaatactgaagctgtggctacaggaaaactcaagatacataaaatgaagccgatgtgatatctcaacctttaatttttcaaaatcgcactggtttttttgcataaattccatctcgagtactgtgtagcgaaccaataatctcatcacatgggcgtctggtgtagttggttatcacatgcgcttagcatgcgcgaggtccccggttcgattccggtgtcgtccaattttttattcatggtggcatgattaccccaaatcctgccaactgaacatcgtcatatattgtgctgttatattgtgcgatgtgaatgtgacgattttattttttgcagctgttgggactgctcaaaaatgtcctgcactttgccttgaaggtgtacgtacagtacagacgttaaacggctggcatagggggcaatttaacgtccgatagtccgtcttcagacaatcatacagcctagatccatccagacaactatacagcatgtcaactcgacgagaacgacagtaatattagcacccctgcttgatttcaggagacaccgctgctcttaaacgtgcctataccatgctagtgtttcaccagttcttaaccagtggtccagcttgttgtagactcccgcttgcgtagcttgagtatgtacggtaccgaaaacaaccgccgttcaaatgtggcctgaaagagaagccctaccctacactatggcttactccacaggacaaccgcacacgtcgatagggcttgtgtaaccgttcggacaatgggaaagggccataaatcaatatttttacttggtacacgtggcgcagtacagatattatcggagcggtgtcgtcaggccattgccgcccagcccacatttcccttgtctacgcactctaacaagtgtgatgacgggaacaagagcaaagaccgatgatgaattaatatggcgactagggcggttttgccaaacacgccctttgtaaatggcaggcatattttgccccaaatgtttcatcgcgacagtatggacgcccacgctgtcggatattattcatttccgtggattctcagacaggaaccgaccatccataaacaactgtcgtacgacgtattgtaccagtacatactataatgtcggtcacacctcaatcaccccactaaatattctaatatctgggctacagcgcacgagaacacgacatctccttctcgcatgtacaactgcaccatgtatcaaggagcgtccagtccgtctccatagcaataggcgaggagagacattattggtttaccagggtttagctcaattaaagagaatgagagtccgaatgagttcagagtgacaacctcccacttgtctcaccatggaaaggctgattcattcacctggaatgtggaagtatgtgtacgattttggaagatactcattagaaatcacaacacaacaagatattaaggtgccagatgttgaaaaggacgagactacaagggtacccgtactcgtacaagtagtatgcgaggatattggcagaaaaaaaaaatgcatatattaacgaacgtgggagtattgtgctactccatgcagtgagatcaactcttaaataggtatgtgtggctgataggccgcacaactgattgtgaacaagtagctagactgtgcaacttacatgataacacaccccttcttcttcttcttcttcacctccgaattcttcctctgatgccctttgaaactcgtcgagatgtttcggatagacgctgccgaactcgtactcttgacactcacgtgcttcgacgctctatcgtcgtaaggcatgttcagatagtctgctccagtagaggacgtggggctgtgggtagggctgctcacgcccattccgcttgtaccagccaaggaaacggttgagccgccaaacgacgagtctcgacgaatgatctgtcgcagaaggtcctggaacacctggtcaatgttggtcttgaacttggccgacgtctcgtagaagggaaccttgccccattggttggccagcgccactccgtcccgaggctgcacctgtcgctcgttttccagatcgcacttgttgcccaccagcaccatgggcacgttgttgttgtccttgatccgacacacctgttgtcgcagctcctgcagctctcgcaaagacgactccgagttgactgagtagaccagaacgaagccctcaccgtttcggatgtacagctctcgcatggcggtgaattgctcgactccagcggtgtcgagaatctccatggtgcagtgccggccatccagattcacctttttgcagtaggaatcctcaatggtagggtcgtaggactcgatgaaaatgtcctgcacgtactggacggtaatggcagactttccgacgccaccggcgcccagaacgacgattttgtagtctctcatgctgtgtatttttttgtggtggtgagaagcgtaggagggctcaggtataagtcatgttttggtagctacgcttgttagacattaagttcacgtgtgaaatttgggtttgtcatcaagttctgggcggatgtccataaacatcgttgtgatagggataggggtggaaaaattacataaaaatgcttgactttattatggctactttttcccatcttttatttgtttctcgtcctacaggaatctcaaatatcagacgctgcccgccactcattccaactcatatacaccaacactaaagcatagtcccaaaactctgtttgttgtctctgtgctttttgttttgtttttatgtcctctttcaaacaggcgggtgagacagttgtgggttgtctttaggcgttttgcgccctctgctttaaggcgtatacgacgcattccgcagacgttgctcggtacagtagtccggctgatggcaagtggcccttaagccctttcatttggccccctacttgtctcgttattcaagccgtatatgccctgcctggctgctatacctcactgggcccacttagcgaagaaccaaaaatagacccgtttattatttcgctctgacacaaatattccgccgaaaagtgccatatgtacttttgtgtcaagacgcgaaacgcgacctctttaggctcggggcacgtgctgtactagtatagccacataaggggtacaagtggcatagaagctgtgcaatattgtggacacgggacataaacaaaccgagcgctgtaccagcctcgtgtctagcataacagctatagttgcgcgcgtgtagatgattattcagcccgatacaagtagaccccgctggaaactcaattgtcaaaacactgttgacaatcatgaaaatcagggcaacccaagaccacaccaccacatacaagcgcggtgcgagacactctgccagtagcgagttcgatacttgtacaaggcgagttgtttcattctgcggtctgaaccgacagcctcacgtctcccactcgctaagaatgtaacgtccactggcagtggtgcgctccttgcattccccttcttctcctgtcttgctggcttcgtcctaaccacacatagacactgtgttgttaggagcgcttgacaacctaaaaacccccaagactgcattccgtcactcccgagatgacggaagtggatagtgaggaatttggggacggcagggcgcgaaccagggctctcaagtcttagaatcgctcaggagatcgtcagatggaccccagacgtctcccttctctcccctggcacttgtacacatgctacagtacgagtagcttgctctgaacgctgccctacttgtagctctgccaactgtgtgtttggtgtgcaccagtcgaacctaaagggttgatacagtgcccaccctcagagccagagatcttcatctggggaaaatcaaaacagcacagacgggtataaacatacatctggcagaaaatgtgcaaaacaacgggcgaaaaatatcgagcccgtgcatttatacagccacgagaaaaggaataagccgctgtccacatgaaacaaaagacaccctggttctttttttttgccccccttttttttctttctgtcaaaccagccacgcgacacctctactcattatgccagagagccactattgttagcttagctcaccccttggatgcactccttcatacttttttttctctccgattgttcaaccacacacacaaggtgcaaagttttccatcgtgtcatgcaaggagtgcctaaacatcaaccaaggaccgatgacagactccttgggtcgtctaactacactacgagtacaatatttatggacttgactcacgtgatagccgctataacctcccatggcaagcttcggttcctgggctcctgatctacaggcacctgccccttgcggatgatggtcggtgttttgtcgatctttggggctagggtagcacagctcatagtggttgttgggtgatctgtcttattaagccgataccttgtaatagcaatgtctgataagccattcggacaagtcaatgtcttaggtgctcctcgcgccaggcatgactatcgtacataccatacaataccagctcgtccttaacctgaccatttactggtacaaatgccgtttgcaaaagtcgcttagtggctggctacaagtagtgcgccgctataaagggtaattgagccgtgccatcctggatcgtaccagtgcgatatcgtacagtagctacagttctactaggactatcacctcacgggccgcgccagattagactgctatatctggtcatcataccatttttgtctcagtcggtataagaatgttgtgcgagatgagacagcatgagtggtttgaatgtgatcttagatcggcgtctggcattgtgttcctatgatacgccacggagaaccacctcgagtgagagcgtcctttagatcgcttttagaacaacttttagcactgctcaccagctctttctggactgaatacgaccagaaaggtgccccggatctaagacaacaactgatgtatcctgtggtcgctgcatcggctgcttttctgtcacctgcggttggtgcatgatacgaagaatgttgaaaagagtccaacagagaagggtctgttatatactgttctacttttacaggttctggcagctacaaaggaagatcattctgagactaaaaaactcctctattgaacttccttccttagtctattgtaccgtacttccacttgattaagtgtcgtcacacaccttgtcgactacctacagtagttaccattatgtatgtactgtacggtacatacatcgtactacctcttccccatgcttctgtgcatgaactagaatgaatacaaatcatattggggtctgtacatgacaggatggggaagccagcataatggttgaaaaagtgctcatcaacgtatccgggactcatgctatcatacacggatggactcatgcatgatgaactcgtcaatatagggtcttgactgctcgtagtaagtatcgtcggtggtaaaagggaataattagcttccagagaggtgcaaactaacctacaagttagatggagaccatggtttgttgcatatagattcatatgacatgaaggtcagctcctggcaaaggtcaaatattgctatcatattctatgctatacgatctgtgcattcagaaacgtgagtcttatcctgtatgcgtatctcacccgagagtaaggattgcagatgcgcaattggatatttacgtggccctgaccttcttctcagctttcatttgtttgtcctatcctctgacttttccttccacagtacgccttgaatcatatccttcttacaagtacaatacgaatacaagtgcatgtactgtacgtacttgtagctactagctaccttatgctggacacttttatgtagacttgtttaggcaagtataaccacagtggaggggtctagcaatgcgataaatagacaaaagacgattcttggaaaagacgtttctgcttttttgttgcacgcagcttgacttctgtccaacaatggctgcaacactatctccggcttcgccatctgccccaggactggcacgagagatcgagaaactccgcaaaacggagtttaccgtcttcatcaacctgcagcctggtctgatggtgtttatcgagttttttcgagctagcatcacagtccacgtggttgacgagatggaaggcatgctgtaccgacacaaggtgatgttcatggatgtcggcattgataccaaagtagtgaacgaaaagtcgactcgagaatggactggatacgatgcaaaggccctcaatgaaaataccattgccatttttgtctaccatgatgtcttcaacctcactattgaaggacgaggtgagctacgtcccctagtggttagagtgggagaatcaactgattggatgggcagctttatgcctctattttccaaaattcttaatatcagtgaccagatggcaaagaccaagcctgagtccacaccagctaagggcttccgactgctccaccgagttccagagtccacaaactacatgatcgtgtgcagtgacggagtgactattcctgttcattcacttgttcttaagtcggtatggccctattttgccaagctgacgagctcagaacctgccaaaatcaaagagggagcatgggctatgccttatgggtcaacatgggttttcccgctgatcaaatactgctatggtgacctggaaacaatgaactttgaggaagcaacgggagcgctgatcctagcacagagatacgatctaccagaactatctcaaattgtccaaagacacattctgggaagtcctctgaacattgagacgtgcctgctgggatggaaacgagcctttgagggcaacaatagcgtggtgagaatgtactgtgctcgacactactaccaaaacatgaaccagcttgccatcagcaatacctatgctgagcttaccaaggaggagttgatccagctcggaatagatgccggtgagagtctgaaacagattgaacggaaataaaaaaaacgtgatttaatgacttcaatacgaaacatgttgtaaccaatattaatttttatctatttgcatgcacaaaacagttaacatgcctgtttcatagcctatacctttcagtgttttagtggcgcatactttcagacgtaccgaggcccctgctaaacaagtatcaaagttgcttccctctttcaaatcaatttactgcttcttctccttggccagctcctcctcaatgatgctttcgacctccttgacgtcggccttgctgaacagcttcttcttgtccttgttagcaaagtccttgaactcctgagggagaacatctcgctcaaagttgtagccctcgagacccttgagggcctggtcgacggcgtcagagaacttggcggggtgagcggttgacagagcaatgtacacggagtcggttccctcaagctttcgcagagcggcagtgacaccaacagaggagtgggggtccaaaatatagcccttggaaatgttggtaaacacatccttaatggtctcgagagtctgctcgtcggagactcgctcggaggaaaactcggactttgcggctccaaggaccttggcgtcgacagtgatgacaccgtcggtcttgagagactgcatccacttgttgagggtggctccagcctcagcgtccgaagaagcaacgttctctcgggcaacgtaccaaaggaatcgctcaaagttggaggagacgaggatgtccatggcgggggaaagggtggcatggacctcggcagaagctccgtcggatttcgagtaggagccagtcttgaggaatcggtcgagaatgtcgttggagttagtggcgatggtgagctcctggatgggcagacccattcgtcgggcgtaaaagccagcgagaatgtctccaaagttaccagtggggacagagtacttgatggcggaggaggtgccgaacttcttctggacctggaagaaggagtggaagtagtaggtgatctgggcgaggattcgggcccagttgatagagttgacggcaccgacgtggtgcttggcgttaaactcggcatcaccaaagacctgtttaacaatgtcctggcagtcgtcaaaggtaccagcaacggagatagtgtgcacgttggcgtcagagacagtcgtcatctggtcctcctggatgggggagactcggccggtggggtacagaatgaagacagaaacgtccttcttgcctcgcagaccgtagatggcggcggagccggtgtcaccagaggtggctcccacgacggtaagagtatctcggtcggtgccctccttgccaacgttctttcgggtcaggaagtactcaaacaggttgccaacaaactgcagagccacgtccttgaaggcgtaggtggggccgtggaatagctccagcagataaagctgcttctccttgctgagctcaaccacgggggtgacctcgtcggatcggaaagtagagtaggaccgggtgacaagctccttcaggtcggctcgcgagatctcagactcgggaatgtacagactgagaatctcgaaggccaactcggcaaagctcagatcggcccacttggtgaggaagtcggagggcagcttggggatggaggtgggaatgtaaagacctccatcgggggccagacccttcatgacggcagcctcgaaggaaatgggctcattggatgatcgcgtggaaaagtaggtggtcatggtggtgaggtacttgtagcactgtctgggatcgaacaggttgatctgagaattgggttggtgatgcattggagtggttgactcatcggtagggtaactttggaagggacatctaacttgtgtttggagggtgataaagaattaaaggagacttgggttgggaattctgtgcaatagagactatttctaccccactcacaactcttttctatgtaaatataccgtttagatgacatgttctacggtgctacgaagtacatactacttgtaccctcaaaaatgcatgttgggacaggttgaatttttgaagtgaactccgaccagaaaacgtgagcatgctttttttgagccgagcagaacgtattattgcaaagaaagaagtttgagacatagaagcaagacttgagcacttgactacgtgacacacacaggtcaaccacactctacacccgctgaaactatcagagccggtatcgctgtgactctttcatatccacactttcgtggagaatgctgcatataagtcagccgctcctccctgcatgtagaagtgcgtgatgatttttcaacacggtgtacaatgttcgcctcttcggtgaatagctatctaaaaaaagtcttacagtatgttatattttataccaacccaacatcttgtaataattgtgatcactcagttcgaggctcaagaagcagagagccaagaggcttgagagacatgccctcctcggtgtcataaacgacctggccccgaacaatggttcgtcgcacctctcccaccaaagtgccatccttgtagggtgagatcttgttcttgaaatgcagcttgtcggtggtgatcttgaccttggcctcgggatcaaagatgcagaagtcagcatccttaccctccttgatggaacccttggacttgagcagacccacctgctcggcagtgttgtaactgcaccacttggaaatgtctgcaacagtcacatttcggccgtcctttcgagcagtggtccacagaatgggtaggcccagtccgacggaggcaattccaccccaagccttgaaaaagtccccggtctgcaagtccttgagattgggggtgcagggagagtggtctgagacgaccgaggtcaccacaccgtcttctagggccttccacagcagggatctgttgtcttccgtccgaataggggggcagcacttgtgctgggtggacttctcggggatggactcggcagcgaaatggaggtagtggaaacaggtttccacagacagaggaacaccctcctccttggcctttttgatgatgggaacagcctcggcagtagccagatgaacaatgtgaagcttcacgtctggcgaggatttggaggcctcaatgattgagttgatggcggtcaattccagcttgtccggtcgagagtgcaagaaggacatgtaagacttggggtctgcattgggaggaaggtctgtagactctccattagccatctcggcgtggaacatgaatatggtggggtgtccctcaatggctttgagggccttcttgacatccggaacctccaggcaggggaactcatccaccccagactcaatgaggaagcacttgaagcctcgaactcccttttcgatgagaggaacgagatcctcggagttacctgggatggcacctccccagaatcccacatcgacccagcactggccacgcgcagctgctagctttgtgtcaaagttggccacggtggtagtgggaggaatggcgttaagaggcatatcaatgacggtggtgactcctccagcagccgcggccttggtgccagtggcgaatccctcccattcggttcgtccaggctcattgagatgcacatgcgcgtcgaccaggccaggaagaatcacttgctcagggggaacggacatgaaatcgtcgacatccaaatctccattgttgatgagtcccttgtggattttgtggatcttggtgtcgtacagaatggtcacctcggttggttccgaggcgccctccagaagagctcggccggcaatagctttcattgtgtgtgtgtagtgtgtagtgtgtggtgtgataagagagaaatacgattgttgatctgggcatctacaagcactcttattgccatgatgattaactttcgattagggttccatcctggtaacatttcccgggccacagacgcacaacttataggatcttctaacaaagatttcgaggctatcaaggtttttatcaactcggatgacattcccgacgaatctgtaaaatttgccagtcgtctactagtccatgtcacccagtatcaaacttcgagatccagagtcgcccatcgccgaaccctaattttttagtatgaaaactaaacgcctatctcatgcatccgaaggtcagtggggtggaggccgcggaatagccgaggggggggcttcaggggtgcaaattacaaagaaatatatcgaatttgtccattttaagtaacgtgctaaaaacatccgatgattaaaggtctttttcatgtacaaacacatctgtggaagtttgctgtggcagatcatgtgtcttgcgaaattaaaatgagcctctgagacatgcaagcgtcctcgcatatatgtgtggttcgagattggagagatttgggggatgactgttcgcttagttgcaccgcctcttattgatgggtgaagcccttagacagcatgtgtcttctcacttttcaatcgcggagttctgacatttactcgtaatcttctactgtgtagtggcttgatgccttgaacttttccatatggcaacaatcatactattacagtacgattcgaatcatcctgggagctcaatgtggtgtggttttgtgaatatcctggtagcttctgatagcttactcagatgcttcaaatagcattgtttcctacatactgtacctctccatatcataccttccattgatctgcgtcttgatgactaaacaatatgaacccatgatatgtgaatcagaacaaggcagatttcacggtggtacatatcatgggcaagtagctacacttcttcgcactggaacgtcttcaccaactcatagacaccacatccgtcctcatctctctgccaaagatctcaagatcaattgtctataaatatactatacatcacgcgctcttgtccacgtctcgttcgccaatgatgtacacctcaatgagatatacctgtgtaacagccaccaatatggtcagagccacaattcccaggttgccgcggctaaagttgacagccaccttgtgtgtcacgtcgatgtcttcattcagccgatcccataggtcgtccaacttcgagtagcttcgagatacagccagttcgacctttgtgagctggtcttcgaccccctcgtactcagctgcggcttcgatggtgcctgggtggatggggttcttttgttcatgcgtaagaggttccatcaatggatcctccaccgagttgtacatgaactcgatcttcttctcggggaaatatggcagcacgtgccggaagcaaaactgatactcgccccagctcttggacaaaaatttcttctttatgatcttgagcttggttctgtcttcggtgacaatgtttttggccggatctcggaccacaaactgcagacccgaagcgccacccttctccaccttataggagtactctatgaagtttccgattttgcgcacatcttcgtagaagcagttttctgtgccgggttccaagagaaatctgaacctcgcgtcatgagcgtaagtgaatgatgccagaagaagagccagaagaagtattagtctcatgttgcggatgaagtgtcaagtgtgaatttcaaataaagattgtagcgaagggaaatggattgaggatgaatgtaatcaatgattgtagaaggcgaaaaatggggtcaaacaacctagcattcaagtgaatctcaattgtcgtattgttatcgaaaagtcgcgaatgatgcgtcccaccttcactggatgtccaccaaatgtcccgggtgtggaaaggcgactagaacaacaattgccgcaggcagacgaaggggcaatatcgtgaccggtagcgttcttttaagactgtttactggccctgaaagatactaaaacttgagggttctgcaagcatcgtttatgcaactttatgcataccagagacaccaaaacagaggccgttgagggtgtttagattaccgagagggcgaagaatattatccactcggcgtgaaacatctttatatttatactaatgccttctccttatgagatgctgcctattatctgttcttttgaacagtgtcccttttcacgcggactatttaagttgggtgccgttcatttgatgaaaacacagaaaacagggtgtattgtgggctatctctcaatctacagtatggtacagcagtgataaaacaccaaagattgacgtgccaaaggataactgtttgtgatggaagaatccaccatcccccaagtcctagattgtcgtgcaccccgctagatctgtatctgatgcacctgcatttcacctgaggcatttacgagctgcttgagacctgactgataacgtatatttttaatgtgttgcggaatcctacctgggcggactcaattaaaagatgggtgacccccgttacaccttggagatatgacctcggatcgtgtctcacaaaatacgacgtgtttaagtatatatcggcagtaaaggtagtgtgcggttgtgcggggttgtgataatgacttaggtgtcgctggagcgagtaaagagactcaagaagatatttatggacggaaacagaccttccgatgacttgttcttcattttaacactccaaacttcctattacatactagaccaggtttcaatgtttttatttttatcactggatctaaacaagcctaaatagagttgcggaaatccgaaaatggaccgtaattaagagctgcagaccggcgtttaaacgggtgacgtcataatagagcacccttccaaacgagacgatttgataaatggccaggattttatatccgagtatttatagatgtggtaaaataccgggagtaagtaatctattgagcacctactgtagtacgatcgcttagtttttacttgcaagtctagttgactcttgcttacagaaggtcatttatgggagatgcatctgattgcctggaggtgtgtgctatgtacatactatagattcctcatgctggctcagtccgcaatataagaggggccaaagtaaattgcaacaacacattagccccccttacactcagatcattggggtgatagacaggatctccaggcagcccgaaaacattgagaaacatgcccaaccctaactaggaagcttcccagtgttctgtagccaccttgttgaaggaagagagtagcataatactgtaggttggtggatatactacgggtcgagctgtgacatatgtggcgtataatgtctgtttatttttgccactcacgtgatttcaccggctctagtgacttttgccctttgagagacgtagtaacggtcttgcattgtcagtaagggtcccgtgtttggagaaatggtggtgggtccagagaattgtagatacttgtacaagtagatgtgtttcgaagaagagaagaaggcgagattatcctacaacagccccaaaacaaatacagaatggcacttaaactccccttttatttattcataagtcttcttgcacttctacatattcctatatctacgcctcttctttgccacacgccaggacaaggttccaacaatagcattgctaaaattcaaattagggtggtgttcacgcgtttatttggtttgggagttaggagggaaaggctcgagaaaacagtgtcggaacaggacatcataagaagggtgtggaagtggattttagggggattcaacaaataaaaatgctttgaagaagtgacggattaatttgggagctctacaaatcctccaccttacgtacaacgccgggaaaatcccttttgaacaaacctaaaaacccaaggttagggaaggcagcacacgcgtcactgtgccagtgtacaaccagaaacaatattaaggtgtctgtcaaaaaacctgaacatacctctcaccacagaccaatgctccgagacgtgagcaagtcgactctcaacattatggaagcaggtgccacggacacgtgtgggcgcgacggcgacggactccacgacgctcgctcgcaggtcgagccacaacacgtggactacgccatcaacgacgactcggtgatacccgactcggagtgcgagcaggaggtgctcaacacggactacgtcggcggcgtgagcaagtcccacagacagggccatcaagggggtgtggtggaagacaccacgttcagcgatcttctggaaatgaacatcaactttgccccgggatccatggaggtgggcgagttgcggacggaggaagtcacgcccgaggtggaggagtgttttcggggttttgagcgccaaatgatgagccacgtgagccacagcaacgtgagccacagcaacgtgagccacagcaacgtgagccacaactccatgctcggaagctatccgatccagagccactgtggatccataggccagagcctagggtatttcgccagtgaggaactgactgaggtggaaaaagggaccattcatgatgagcgggagcaggaacagaagcaagagcaggaacagaagcaagagcaggaacaggaggagcagatggaggagggtaatgaagaacagagcaacgaacagcccgtgactgaacagtcggagtctgttagtggaagcgaggagggtcaggaggttgaggcaagtgaagctggtgttctagctgtcattgaagatgaagttggagagaatggcgagcctggtggagcgggcgattcttctcatgccattgaaatcacatctactagtccttccaagatcgagattgctattgaagatgaagatgaaggtgaagatgaagatgaagatgaagatgaagatgaaggtgaggctgaagtagacgaagaggcagaagaagtcgaagacgagctagaagccgagtcagagactacgccaaaggtttctgcgtccgaaaacgagttctcacacacatcgcactttgaaactccagcagctgagacaccaaaacacgacgaggaggttatcgcagttgaagccgatcaagacgtgtccatgatgaacgtgagcatggaccgaaccaaccacgatgtgagcatggcagaaacaactgcagtggtcaacaccactagtggagatactactgtcacagacgaagcttctacagctctaacagcacccactacacacacacatgcagaagacactgcatcgcaggctactgtttcgcgtgagtcgtcagcccaagttggagcaactctcggaacaagtgctaagcccgaagaaacagaaggagatacaacagtcactgtgacggcctctgctactccagagaacacaggtatggacgagggtcctcctgtcctatctctcttggacgtagatggtgatgtccatatggagatgcaagaggccaatggtgaggttaatgagcgcgatacacatggggaggatacacatgaggaggaggaggagatgacaggggaggacggcgacgagctggcagatggcgaagactacgatatggcaggcgaagcagacgagcaaccacagaaacagactattacagagactgctccaacagtgtcaccggttgcatctttcccagcacttcccatgaacacagctagacttactcgggaacacaagacgattcccggtgaggtaacaccagaagccaaattgattccaggtgaagttcctggtgagaagcgtctcattcctggtgagaagcctgttgccggttctacgaagaagcccatcccaggagagattctatctgccaaacgacctcttcttgacgagactcccgtgtctcgatcagctcccactgttgccacatctaaactcattcctggagaggttcctcgaaacacatcatcatcatcatctgcatcgaagattcttcagccgacaccacgagtggcattgtcaatgaagcctccggagtcgctggtttcgagtgttcgagcatcgtctcagcctcctcgtcagctgactcccattcccaatctttcgcattccgacgctcttccagaagaccctaccgaccaggctcgacaggctctggctcgaaaaagacctctccccaagcgtccccagggccgtaagatctctcacgagaccactctggagctgcagaacttcgagttgtcttgcaagggtctttctgatcactatcggcttctggacaaggttggcgagggtactttctcctcagtctaccttgccgaagacattcattacgacctcaagcgtgaatttgctgctcggaagaagcagaaccagtcgtccagccactggaagtctccccctttgaactccaagaagcggattcgattgctggagcgttcaaacacagatatccatcggggtccacttgtggccatcaagcgcatctacgtgacgtcttcgcccaaacgaattcttaacgaaatcaagattcttgacgcgctctcaggctacgacaatatatcgccactgttaaaggtgatgcgccatgaggaccaaattctcgcggtactgccgtactttgagcatcaggattttcggtcgctgtacaaaaccggctccaagacggacatccgtatttatattacccagctgtgccaggccctcaagtttgtgcattccaaggacatcatccaccgagacatcaagcctaccaacttcctctacgaccgtcaccgacggtacggggtgctggtggactttggactggcagaagtgcagtcattttcgacgtccaatccctgtgtgtgtgtttctcaggaaaaccagaaacgtattttgggctcggcgtgggagctcaagcccaagggctcatacgagaagaacgacgtgcggtctggccggcgaagcaaccgagcaggtactcgaggctttcgagcccccgaggtgctgttcaagtgcacctgccagacgacccagatcgacatgtggtccgtgggcgtgatcttgctgtcattcctgtgcaagactctgcctttcttcatgtcgcacgacgatgctgatgctctggtggagctatgcagcatttttggccgccaggctatgcaccagacgggtcttctacatggtgcttttcttgagctccagatccccaaactgcgaagtacaggcctgccgtttgagcgggttctgttacaggctggatgccccgaggagtgggctcgagatccggtggtgattgattttctcagcaacaccatgaagctggatcaccaccatcggttttccgccgagaaggctttggcccatgagttttgccagcgtgcctatgaggaggatgattacgtagacgtataactggggatgaactaattatattattttattgcttttagtgggtaggcgcataattatcaaccgtcttacagtcgtagttagataagagacgtcgctataaatcatacagtagtgagcgcctggaagcaatctactaacaattgttttcgcagcttgttattcgcgtcatttgtatctatagtacacgtataactccatcttctacaggctgagctcttcgactgatcccctcaccaaggagtacatattacgtgctttgttgagaagctatctaagtgtcaagtattgagtaaaaacaacaacacaacagacatttgggttttgtttttgaacactcgaaaatgggcacacaagttgtcagggcaaagacccctgttcgaacaacagattcggatggataagttttgcaacacgtgatgtgtgcttctctcgaattcaaccccaaaatgtaaaattgcgctcaaagtgctgcccaagtggtcagaccacagcatgtgctatcgtgcatactggaagagctaaaagctggtaaccactttggctcaaaattaatcttgcatcagtcagtctcttgtatcgtaccaagttcaacatacaaccacacacacacacacctcgttgccatgtcgtacaacggaataggtctgtccactccccgtggatcggctacttcgggtcatattcagaccaacatctccaacagagcgtttcagagcactaaccacagaggcgaatttgcacaccatgagatgacggacgagcaagacaaacgattgaacaagaagctggacagagactacgcagctgaccgacaggctgacgtggagctgctggaacatgagcgaaaacgcaaggtggaggtagcatgcatggagctccaggacaagttggaggaggagggacagaagggagaggaggagattgaagaggaggtgaacaccctgagacgtcagctgacactcaagatggctcgggaactcgatgtgagaaccaccattgtttctgcggatcgagaagctctgcgaaagaactaccacaaggcagccgtcatcaaacagcaggaaatggatcgaatgagagacgcctttgataccacaaagaacctggatgaccgaggacgtgaccggccacgaaaccgacagcgacaaaatcgagaaaagtcgcccgtcagggacacaagacgatctagaagtgctcgagaacgatctccctcccgaagaggaagacgtccaagacggtactctgttactgaagatgtgagaacctctgaggtgatttctgagcgacagggatcaggatcgccatgccggagagctgactctcgatccagatctagaagtcccgagagaggctcccgacgaaaaagctacagagaaagatctcgatctcgatcccgagaaagaagtgagagaagaggaagacgagacagcgtcagagagagggagcaagacagatctcgatctccattaccctactagtagaccctccattaacagcataatatgtttgcgcaatgccaagtatgtaaggctatatgaacaacggacataacaaagctgatctacagaatctgttttcctagctgtggagataaaccacttgctacagtacataaaaatacagggattgtgaatgaaaaaaaaaaaaaaaacctcaaaaaacaaaggaacccttaataaattcttttctattcgtagggtgaaaaatgctctcaaaagtcactcaaactcaaaaatatgatgacagatgtggggttcgaacccacgagaacttgcgttcagcagatcttaagtctgccgccttaaaccactcggccaatctgccgcgatcgtgtcgagagccgaaatcatatttactgatcttgagctccaagtttcgggaaaatcacgtgacctgacaaattatcctcctaaataagagatatacgggttctggaaaaacggatcatggtcaaatgagtcgttgcggattcaatgagacaataagaatagacaacttcttgaagcaaagtctccaaaaatgccattaatttttgaatagaactgatgacgtcataagaaaactctatttaagctccagttagccgctaccccacatagcagggttgtccatatacggcaggtatatggtggtagctgtataaaagagaccgaaactgtgctcccggggaaacgtctagtaacattagctaccagttctttattcgtcccattccctacacgcgcctatgaaattaattgcccccttttttaggctttgggaatgtagtgccgatcacagctttctgccaaaaggcgttgggtagcaattatgatcgtcttccctgcattggagcttgtgaccaaagctaccaatgactgtgtggaggatccactgcgacgttagattaggttgtgttaacgcctaaaggctggaatgagtgtgctctgaaaccgcaggggtgaaggtggcaaatgctttgggttgaggcctgactgctcggtgtgggtggttaccgtagagttgtttcagtgggccattttgagacatgtggggtatttctaacttacgcggagcaatcaggcagggcggaggtaggtgagaccggagctctacgggtggcaagcgacgagaagttctcactctgtggttgaaagattttgttgggtaactgacgcgtttctgatgatccttgtttgctggagcttgagttgaatgtagacattgagaagcgagttagaaagagagtgtaacgtgaaacgtcagcaagttacagtaaatgtaccgtacgagtagagcatgtgcccactgcgtgcattacagaatattgtatgtagggtgtcatactgtacactgtattttcgcaaacgatcatctaaagatggactatacagcggtcttacagtaccgacacttgaattatagtgctacaagtatagtacgagtatcaatctttctcccattaatgaataccttaccaataaatacaataaatacaatgctacaataccgttctctgaatctagtcatgctcgctgtatccagcgccagcagacattcgggtgactcctaccagaccctccttatcgagactcagacaatatctgccgagagcagacatgagaagagcctgcttatcgttctggaaggtcacctgtcggttcatctgatccaccaacagtggcacggtggcggcgcctcgatgcatgtaaatggtatcgaatctctgcttagtgtggccccactccatgtagggaatgtcccggagaggtgccttgaagggctcgataagatctccggctttaagagtcacagggcagttgacctggagctctgcaaactcgttggcaatcagagtctgcttgcctccagtgatggactcaacgtggaagcacacaggaggaccatgtcgacccatgaagatcttatcgcccgccttgatggagccctgggagactcggccaaagatgaggtttccgggcttcacggaaatgatgtcgaagcggggatcctggccaaatgagggcatgagtcgctttcgcaggttcttcttggtctgctcaccggcagaaatcttaaacagaggaccaacgtactcagtaggataggagaagtgcgactggagcttggtcttcccctcaagatgctcgttgacgactcgtcgcacattctcgaggtctgagggctcacagacccaggtgatggactccaccttgaagaagacgaagagcttggccagagcaagaaccttggtagacatatcgccctcgcacagaacaaccatatgctcgcagtatgatgccaggttgacggccgaaccgtggaagacatacagagacgtgtcgttgtcgtagttaatcttgaatccgttggtttccttaccgggcatgtagttgcatcgatgaagcaggttgttcacataggtgttcgtggagcctccagtggcgtggcagataccgatagcaccaatgtattgcttgttgacgatgtagggggttccgccagatacagactggctgtaagtcattgtcatggacattttcgaaaaagttgtttttgtctggggggatggagaagtgtgagaagtgtacgagctgatggaaggaacacctggactagcgaggtgttacatctatatatatgctgggctttttctttctctcctgcttgagaggtcttcgtcttatgcgtaagcggaatacgatttgagttccgaaggttagtgttcgcttcccttttgtcttgcttgtttgttttagcctccaaccccgcaaaactaaaacatttccattttgaaacctctggcggggtgtctagaaactcgtagtgtaagtatctagctcgctcacaacactgaataaatagtaacagcagttagctaccgttcttttctttgacaccttccaccatgctctttagcccaccacgacctccaccttatcagagtaatgcgctcattgaactctttttgcgccccactactgtgcgtaagccaccaagtggggatggtgagacatggatcgacaagaaaaatttcccaaagcaagcgttgagagcgcccatcacttgagattaagcggggatagaccagtcgatctgtggggttggggtagggcacggaaatgataggcagatgaccaggggggataagtctagctccgccctagttactccgatacacgctgtgtcgcgttttgtttttggttgagttcttctttgagtcgcaccatctgtcgcaagtcgctagacccctgttaaacaagcaaggccaggctgcagtgcctcgccgaacaagggcttatcatatgtagggtagggatttttggcgctagttgtaatccacccacactgtagtggccccagtggcatttttgcgcccaacatatcattgtttcggtgtttgacgtgtatatatttctgtggtctacgtttccttgcggaacataactcgggcatcttgtcgcgtcgaggctgggagtggagatacaagtacagtatgtactgtatgtactcgtgccagtactggtatacgtttaagatgggtcattcatccactcaaaaggggtgagtgggtatcaacctaccatacaggctacgatgcagagacacacccaaatgctgtcattttacttttgtttcagtctcctatcccctatatccacacatcctgccacagcaagcgcagtcgctattgtacatacacccggctgttgtgctgtccaatcttccagttattttctacccttgctgcatcgaacgtcgatcctcacatgtcccgtgacgcttgtactttaatgtcattgtatggcagttgtatcacaatatcgatcgggagggatggaaagcagggaatcacattcgaaccgatgagccccacgaggggtacttcctgcgccatctcttgtggtgcctggacctcttgtgtggacaaaaccatctctggaggctggcattgtaatgcgcgtcatttgctcatagactttctttttgtgaccccgctgtgcatggtgtgcattcattccggctgggtgtctttttaagcctcctcccaccagaaggctaaccttggaggaccatcatctgccacacacaggtgaaggcaaagagtacggtggtcagcaaggcatatggagagtggaaaatatgtgtgcaataccacgaaatacaatagtggccactaatagaaaatggctacagctgcacggctgaaacaaccaggtacgactttccccacccactaatatcctctagttccaaaagtagccgagccccgtatacgttacatgctattccttgtcgcgctggtttcttcttctctacttgttcggtgactgaagcctcttctctgactttgtccctctctcataattctgtccgtactggacttgtaattacaagtacagtggcatgtaccccgctctcaagggtgttactctgacacaggtttcaccttattactataccagcggaaataagacaagacaagcagcaataaatgccagtcaaatacgtcatccgcagtgagtatttgtccacagactttccagaggatattccagctgaccagatgtatcgattccaatcgatacacctgctctactctgcgtacacatcacacatgcgcaactcatgtggatagatagcagcgtcccgcatacaattccacagatccttggcacaagtatcgccagattccggtttcggttaaatacaagatgactgaaaaataaaggctacttacagtaatccttgtcctcctgaaaacaccagcttccccactcttcttgtttctcgtatccatgcatatgcaggtggtcgtcacgataatggagatagcaagctgctcgagaagctatagaagtatggtttgaggtatcatacgttctcatcgctgctgaaaaggctctttctcaactctcccgcatctctcaacgtttgtgacgtcgtcttttgaggatttctcacacagtgtgtttgtagccttctcttccgagtttttacaactctgagacatgatctcggagatgagaggagaacaagctaactcaacaagaaggtcgggccggccctacatctcgagatgtgcacttgtcgagcctttgtatcctggatcgaaagtggcaccagtaacgcagagtggggcatatcaggcacaagtttttttctcgggtggcttggagttgattagcagacaaagcccaagcttcatctagaggatcctctgtcgtacgagtacgagtacaagtacttatatatgtgtgagttctatagagcctccattagagaactcgatgatcagctctctccactatacgcacgcttgtatgctgaagtacaagcgactcgctgccttaaacctgcgttttagccagagctcaacagctgccatccaagcatttatctcaaacagtctcaggttgtaattcattggtaagtgagacggcggtctagactttcttagtatacatccgatacctattttgccacaaacatcatttcacatgtcggacttgccccgctcttagcctagcgcatctcctgctggtatatcgtacaatggaaaactcatcagtgacattactactcgtgctgtaatgctttatatatactataccccctcgattttttactgagtcaatagtctcacggcccagtcaactgacagggttcgtagatcagtataatgctgaccagtacccacaaacagcacgggaatgttggtcgcgtaggtcatgttgacaatcgaaccgatcatgtctcccacagtgtcacattttgaaatgaggaagaagtccaagtttcgatccttgccaaaggcgtcgttgaagtttcgagcctgctgcacagagtcagttccaaccagagcctctcccaccatgatgattttgttgggtcgagctcgcttagcaaacttctccagatctcccatcagacgcttatcactatgacgtcgaccggcggtatcgatgagaaccacgtcgaagccatgcttctcgccgtactcaacggccttctcagcagtgtgagcagggtctttaccgtatccctgggcgaagagctcaacctctccagttccctgacgcccagcaagctcactgagtcggttgacatggacacccagctgctcgacagctccggatcggaacgtgtcacatgcagccaccagaagtcgcatcttgttttgcaggagccagaagccaatcttggacaggttggtggacttgcccacaccgttaactccaaccacagaaataacatagggacgtcctccaccgagctttttgtgccgctggacctcgtggagcaggtctagagaggccgaaggggtcagaatctttcgaagagcgtccgccatggcctgctgcacggtctgctcgacggtggtccacgaattggtagtgcagccgactagtgaccgtgacacctggtcacataggtggactgcaacctccttggccacgttcttcttcatgagctgctcctcgaccttggcagtcaccttgtccatatcttcctgtgtgatagtcttaccgcccatgatgttcttcaggaaaccgaatctcgacttggaggggatcggaggctcgtcgtcacccagttgtttgagcacaaaatcgccctgcttgttggctcctccatagttggtcatatccacatcttccacaacagccgtagctcctgagggtccagaggagaagtcaagatccgcgtcgtcgtcagaaccgacatccagggcttggccatcctctccccattttcgcatgacacccttctttttcttttccgctgtagagtcgtccttcttgcccttctttcctcgccgacgggtctttcctcctccaataggtgtagatgctccgctggctgcagagtctgtatcgacaacagtaacagacgactcaatcttctcgatcacagggacctttgcctttgccacgggctccggcttgaccgtctctgcctccagggaagccagttttgtagcgaaccatgcttcgtactcgttatcgtccaactgggggaacagttgtcgggcttgggtaaccagctgacccacccaaggcagatgaagaagagtcttgtaaatgcacacaaatacgagcccctgctcgttggcgactgcccatcgggccgtgtaaatgtccttggtgtaggtggagtcctggacgggataggactcttcgatgaacacgtcggatatcagatcattgacaatatgtgtgacgttggatgctgagggaggggagtactgccacttgacaattcctccctttgtaaacgcgacaaagtggtcaatcatgtttgttgtagagagaagaatcggcctgctgatctgttgatttttttttattctagggatattccagtaggttcggggatatgtagacgaaattaggttagcataaacctgcacggcacaggagtcgaacggacatgcgtattatggggtgtgtgtatgtcagcataacacagagttgggacttttaatagctatcaaaaacattggcatacagacgagggcaaagaaagccagaaaacgaaacaggctcatcggcacgtccaaaaaaaaaagacacttgcgaaaatcgatatacgcaaaatggtcgcgataaatagggcgttatagacgcgacgaggaagctgggggagtgtacaaccagacggagaatggccagggcacataaaaagaatgcctgagtcgtttccagagtggcgaaaacaacacggatttgaacttccgacttttctttgcttccaccagagccccaatatggctcccttcttctcacccacggctttccgcgtggtgatcttcgtacaatagtgtgcatttcacacttctctctcgtgtgacgtaagagggcacacatgccacaacaagacagcaaagataaactctacttatacacaccagcaccacccatccatacacaatgtcaacgcctcggactgtgtggcgccgaagaggcgaggagtcgtccagcgaagatgactttgacctgaccccacccacccggaaggctgccgccaacaaaaactacgttgagcccagcagcagtgaagaagacgaccatatccgacccacgagagacagcaacgacgacgacgacgacgacaacgcaaatgccagcctacaagcgcagctggcgtttgacgaagacgagggagtggccgattcgcaggccgattccgaagaagagggctctcgtcggaagcgcggtcgagctgcaagcagcgagaatggtaagtccgttccagtcacacttgccatcgggtgtcgattagcccagatgatggagaatggaggtgagtgaactacgtgaccaaattactacagcagagattcgcgacacactcgatgtctcatgtctcacatctcattaggtactaacacagctattggaaaacgcagaaaagtggaggatgactccgactttgagattgaagtaaaaaacgacgactcggacggcggatcgccttcgccggcttcggactcggacgatgtcaactttggttctcgggctcggaagaagaagggaagcagacgcaagggcagatcacaccatgctacgggaggaaagcgacccagacgcgctcgttcacaggtccccgacgacgatgaagaatacagcgccagtgataactcgtcggacaacgaaggctccaacgattctggtgcttccgagagagacgaggatcctatcaataactttgtggaggacgatgaagaggtgcaacccgtgcgacgatcgaaccgacacagaggtctgggacgacgggaacgaatcgctattgctactgctgacgacgatgatgacgacgacaagcgtctgtcattggctgttgagctggcagaactgagacgaaacgatccccctccaatcagaaagaagaccctgagagctcgaaaggcggtcaactaccaaatactgcccccacccaccgtggacgaaccattcaatgcagatgaggcaggtgcttctgctcccacacgacgtcgaggcaataacaatgctcttcgacgtctcatccctacagtgggacccttcggcggaggcgacgtgatgcctttgtttggaaacaacgtgcctggactcacagctgttggtggagccgacgatgacgactccagtgatgacgaaaagatcaagggtatccagggagctcctggcattgccaagaagaagaacgcagtggcagacacggatcctctgggagtggacatgaacattgacttcacccacgtcggaggtctcgacaaccacatcaaccagctaaaggaaatggtgatgctgcccatgatgtatcctgaaatcttcaagcggttcaataccactcccccgcgaggtgtactgttccatggtccaccaggaaccggtaagacccttctggcaagagctctcgctgcgtcctgctccactgaaggaagaaatatcaccttctttatgcgaaagggagccgactgtctgtctaagtgggttggcgaggctgaacggcaactgcgtctcctgttcgaggaggccaaaaatcagcagcccagtatcatcttcttcgatgagattgacggtcttgcccctgtgcgatcgtccaagcaggagcagattcatgcctccattgtgtctaccattctggcattaatggacggtatggataaccgaggccaagtgattgttattggagctaccaaccgtcctgattcagtagatcctgctctccgacgacccggtcgattcgatcgagagttctatttccctctgcctgacaaggaggcgcgaaaggccatcattggaatccataccagcaaatggtccccccctctgcaaccgcagtttgtggaccatgtcgctggtctgaccaaaggctacggaggagccgatctcaagactctgtgcaccgagtctgcaatcaatgccattcagagaacataccctcagatctactcttcgcatgccaagctcacgatagaccctgccacaattaatgtgcgagctgctgatattctgttggctgtcgacaaaattgtgccctcttctgcgcgatcctcttcttccggggcgactcctctgcctcctactgtggcccctctgcttcagaacaccgtcgatgagctcaaggaccgtctggactcgattgttcctcgaaagaagaagctgacagctttggaggaggctctgtttgaagagttccccgacgaggacggtgggtttgcacgaattcagcgacagaagctgtttgagaagtcgcgaacctgccgacccaagctgctcatctctggtgacactggtatgggccagcagtacattggcagtgctcttttgcatcatctggaggggtttcacattcagcagctggacctgggatctctctatgccgatagcagtagaactgtcgaggctacactggctcagatcatcactgaaagcagacgtcatgctcagtcggtgctgtacattcctaacattgagttctggcccacaactctctcttctcaggcactgtccatcttctacactctgatgagacaggcgcagagccagaccgagctacttgttctgggtatctctgaaatgccttatgaagagcttcccggggacttgaagtctttctttggggtagctgcttctcgcctatattccattcgaaagccctcactgtcagagcgacgaaaatattttgagggtatcgagcagtacattgtggccaagcctacagactaccctgaccctgcgacccgaaagagacgaaagctccccattctgcccgttgcacccccgcctccgcccagggagttgactgcctccgatgtcaagacgcagcagaagaaggacatgcagctgaagaacgtcatcaaggtgaagctcagtggactgatggagctgttcaaaaatcggtacaagcggttccgaaagccacccattgacgatattcatgttgctcatctgttcgagcctgagattgatccccaggctgctgctttgcatgatttcagacgttctgaggacgacatgattttgcaggtgtccactggcaagaagtactacaactacgatctcgatgtgatcgaggatcgggtttggaatggctactactcggagctcaaacagttcctcaaggatatcgagtacatctaccttgattccatcacctcgggcgaccgcgagcgacgaaacaaggcatcggagatgtttgccaatgcccaggtggccattgaggagatgagcatcgaccagcagttcgtcgctgactgcaagaagatgcgacaacgagagattgaggctcaggagaagtggaagattgagcaagaaagagtggaggctgaggaagccaaggcgaccgctgaacaatacgaggcagaggcccgtcttgctgctgaggtacaagagcgagaagtggatggtgacgacggagatcccgatgtcaatcagatgcaggtcgacggcgagggtatgatcgaggaggtcaaggacgaggagatggctgacattgacgccgaagatgagaaggttgacaacaagacagaggaagtcgaagtggctgaacccgttgtcgctaaacctgctgtggtcgagcgtgctgttcccgaccctgttgtcacagaggtgaccgagacggcaactattggaaccgagcccgccatcaacggacacgccaatggaactgtcgttgaggaagagaacgtggaggctgaagtccaggttgcacctcctgtggaagcttctccttctccccctcccactcctgatcctcctctcattgtagacaccaagaaggctcaggatgtggttgacttccttgctggtaacactggcgagctcactatcgaggagcttgagcaggtctatgccgccatcattgacattatatgggcacaccgagcatcctgggaccgaaatgtcataatcaacgccatcactgcccagctggacgagatcgtcaatgctttccacgaataaacaaatagacctatattaattaatgactacagtatgaaattgttaaattatcgatgactgtttcacttatcacgtaatgaccgctgtgcgtgcttttactgaggcacctccaccacccgtgttgtcagttctgagtctattaccatgtagtcaatctatatatacatccactaatcctggtggagctccttgcacttgtccaggagcagtcgaccgaccttcataacgcccaaatcatcaccgtactgtcccatgatctgcatgcctacgttgccctgcttggtcttccagggaatgttgagggaaggaataccggtcagggaagcagggacggtgagtacatcgttgaggtaggtatcaacgggagcagagtcgttgagcttagaaagagggtaaggcgcacagttagaagtgggagcaatgatgaaatccacaccgggctcatcgttggccttttgaccctcgttaccagaaagcacgttgggtcggttgaagacctcgtcgaaatcctcctgtagaattcgtcgaatcttttgcgaccgaatatagtcgtggttgaaggcgtctgtcgacaggttccatgttccaagccacattcgccgcttgacttcatttccaaagtactcctgtcgagtaggagcgtacagggtaccatgttcccctcggtcctcgggagctcgagatccatatctgataccgtcgaatcgtgcgaagttcgatgaagcctctgctggtgcgatagcgtagtaggcaggaagggcgtttttgatggcaggaatcgaacatgtgactacttcgtggcccatcttgatgagctcgtccatgatctgtgaccacgccattttgacattctcggagatgcccttaatgttgtattccttgacgagaccaaacgtgagctttctgtggggcttgggaggcttgagcttggctctcttatggggtgtgagactggtggggtccaagggatcgtacttgttgaggatgttgaacaccttttcgagcagatcgatgtccttggtgagaattccaactgtgtcgagagactgggcatacgcaatgactccgtgtcgcgagataagtccgtacgagggcttgaggccaatgacggagcactgagcggccgggtatcgcacgcttcctccggtgtctgttccaagagcaaaatggcacatgtctgcagccacagcggcagctgagcctccggaagaaccaccgggagtgtgaggttcatcggggtacagggggttgaagacaggtccaaaccatgagtttgcattgtctgagcccataccaaactcgtcgagattggcctttccaacaatggaaacgccctcttgtttcagcaggtcgacaacggtggcatcgaagggggatgtgaacgtttccagaatgccagatgcacaagtggtgtgcatttcgttggtgcaaatattgtccttgacggccagtgcaattcctgccagggctcccgattgagccacctgggggttctcggcggtagagatcagagcattgctgtagggattactcttgatgatgttttccatacatttttggacggtcagtcgtgcactcatggctggtatggtgaggtcgctcaaactgttgatttgacttgctgcttgtatgcagatgttcagacatgcttgtgctaacggagtttatttgagacttcgtaggtgggcgatgtagttcttaggagtacaagtagcttactggatggctaagaggtgggtttaaataagaaattgttaaatctagcacgtacttattcatcatttacccagcagtagattgcttgtatcgttgttccaacagtacgtatgtcttggccagttcaaacttgatgtgaattttgagaagctaggacttgattaggtgagcatttggacgctctcgtgaatcagtgacaaacccagaagtatacttgagtgacacttgatttgcttgtgagtgggatctattgaattcgtggtgtgctacgatacaatggacgaagcacattcgtacattagtaagccaatccagaaagacatgattggagagtaagagggtgtgaagatcgtacaacacgtagagggatttatgggtatatttgttgtaataccctaaagatggtacacagactatggtagactgcgctaacaggagctacaagtgctgtacgagtacatacacggtgccccaagacttatagccatggaacatcgaaatggactcaatgacggaagcaagagacatgaatgactatttgggtgataacagtttacgtcacattggtatagagcaaccctatagcccctaaaaatcgtcgcaacacccattcaaacccatgtccagctcaacgaccgaacaagggccgagtgtggacgtcgagagacgcacaaacgccacagactataccacaaggacgaactttctgtcaatcagcacagtacttgtgtctacagtaggttaatggatccatctaacctgcgtctgtgctgtccaagtcacgttgacctaccactacttgtagctaagtacgtatgacagcaggggtagaagctagcggaggtttttcggcatcttttgttgtaacatgtcgtttgtttctggatgtggcaagtgggtctttccctggatctcgtaccagctcgctagatttgaatcattggttccggcatatattcggaacatattttgaagctcatacgttgtactgcgctttcggccccctacctcggcctccatatcgtgcatgacgtcagagattatgtagggagatgcggatgtggaccaatgggggtccagaagacgagtacattacgagaggtggaggaactcacaagagacacgcggaaacaaggaacctcagggtccacacatcgagacgttcactcgagtgctaaatgtgtaatatgagtgagacaatcgtgacagatggtactaaagaccataacaggcgatgaatgactcaccacgataatgaagagacaccacaaccaactgcgatacacatgagacgcattgccagagcgcgataatgccacccacagccaatgtgtccctttctaccgcccaattacactcctctcacccgcacattacccctttgtgtctcgtcatttttggccccaagaggtaaaggataagattgagtcattgggcactgcaccaggggtgtacaattagtcacatgcagtttaatgtgtggggaattatgtttcaacaaagagcaaagtggaggggcaaaaagcacttttgttggcgcaactttggaaaatctactctccttttccacgtcacagaactcgtgttgtatcccaccaaatttgccactgtatcagctgaatagaggctgccggattaattatgcccagtgtggtcccagttaccctctcctattggccgaggttcggtaggttgcaccttatttacattatactttagggtttgattctttgtgcatagactgtcagctcgacacgcaaaaaagtataaaaaaagggccatcgtaacgtatatataccaaagaagatcctgccaagtttctgaccattaaccaccttcatcccgcgctctcaccctagtcttcaagctacgaacagctgactatcttcaacacacttccacaccaattcaacatggcttttattcccctcgagatcccttccaagtctgcctcttctcagtctcttgatgagctgaagaagggctctacctcccccaccgacgcccaggccacctatctgtacggccctggtggcaaggacaagacccccaaccccgagaacgataacctgactcgtcccgttctgctgcgaggtccttcttccaagaacgaatactctcgatattctgagtacaacgagaacggtcagtttgagcgaaagtaagcggtggaccttcttcactctctctctacctctaaaaatatttattctgcatgtttattctgcattaagcattgattgccacaaaatactaattgatccttgtactgatgtcgtcgttcgtagattctttgaatgtctcttgctcgtaaagccgttatttggctgtgttagactaacaggttgtacaggaccgccacaaaccttgtgtagagctctgacagacagaaattttcagcctccatctccataccacgactcaccgctcagacagccgatggatcaaagatccgatgagcccagtaatggagctattcttcattaggcagttcattgcaatgtattcgggttttcaatgttgccgctcctctataagtctcaaaactcctacggcaagttttagacaacacgtttaacttcagggagtgtggaactttttatgtaccgccggtacgacaacggcttttgctgtgtgggcgtagggtggcgtttgcacttttcccataccaatgaccgctcgctaatctgtgatatgccaatctgggatatataacccgaaccatctgcttcgtcgtcgctaaccgaccccaactgctccccccgcctttgcaccaatttttcttttagtttatgctgtgaacaggcatagaatttgagcggaacaatcgctttaggcaaccgcaaacagatggttcggttggggaatggaaaaacaacttggagccgtgtgggggtacgttgggggaacaaaatccagtctggggtattagctataatgtttaggccaatgttgaaccccgtcagaaggacttccgtggcattattcgggatcatacattgacaccacttggctaccgcagctgtatgaggccggtcccaatacaccagtcgccgctaccgcaaccttagtttgttgaaagagcgcaatcggcgtaaattggaaggagggacatcgagatgcagcaacaaccgtggagtcaccagagagtcattagctgcaacactttcagatccatgattggccgtgtgttctcgtggcggtgcatgtctgtggtgtgtcgttgtcgttaacacgaaaatggcaccaacaatgttgatccggggcgcgctagcttagacccgtttgtgcagacatacacgcactaacacccactactgctcgctcaattgtcccgatgcgaacgttgcaattgtcgtgtccttttaacatctcgtttaaaagacgctgatcgtgcaccatattttggctccacagacatacaaccttggagtaattatatgacaattgccactctcaattgaatcgtgagatcataacctcacatcattactcgaggaatactacagtatgcacacacacgccagacgtcaaaaaatgttggggtaccttccccgcttttattgagccgtcttggctggtataattacaggatgccactatgatcgacaatctccccttcctctaccatcattggaccttgcatacttgtggtggtacttttacttgcactcgtagcatatagccttcgtcggctcagatgtgtgagacataccgaccgcctaggttcatacggagtattcatcagattttgtaagagaacgtaacctggagaaggatcaaggtacatgttacgtgatcctcatcttgtcattctatctctactatctttgccattttgccactaattaaccccactggtacttacatatcccttggtacttacaccttgcgggatacttttctgaccacccatccatgcacaggaacatgtggctgctatgcgtggctacaagtacacaagcaaaacgcaaaagtaatgacgaatgttttatgtactcgttgtagatgcgaaagaatacattctataagagtaggtgacacacagatgcagtgaaacttctccgtggcacccagggtcgagctgctcgtaagcagtggttgtttgaaaccgttccctgtgaaacttccagacacttgtacctcacaaagctttttcttaggccgtgttgacagttgttgttcttggtatcatttcgatcccaataaatcacatctcactgcttctggtatctacactctgatccagtcctcatattagaaccgtatgatgtgatctgtagacgcgtgtcctccaatatgtagctaatcactgtatatcgcaatgttgacagccattcctcgttttgaggttacagtaaggtcactgttgcagaaaatattagtaccactcaggggtcgaacttcgagcaacttgtataagtactcaagctggtcggctagccgtttactcatacttactcataacctgtggcgggttatttaccgatatgtttctaatcaaagccgaatactcgaacaacatttcttgttttctgcatattgtccaccgtctgtcttcttccatttctacaacgcactactcgtcggcgacctgggtcaaattaaattttcacttttggaacaaatcatgcacgtgctagaacgagcggtgagggcgtcactcagtccgaaaggaggggtaaaacatcacaattcgacgaaataaaatgttaagatagctttaaatcaataattgaatcagccagcaacttttcaacatcaaaaatacctcttaaccccaattaatacctttcgtcttcctgcacagatcacgtttagggttgtaaaacccaacctccacgtatatatgcaatttggtagttccctatttcttcctttccctgtacacacacattcataacaaaaatgtccactcccgcttacccccttgtctgcctcggcaacccccttcttgacatccaggtcaacgtcgatgacgcctacctcaagaagtacgacctcaaggccaacgatgccattcttgttgaggataagcacatgcccattttcgatgaggttgtcaagctcgacaatgtcgcctacattgccggtggtgctgcccagaacgccgcccgaggagctgcctacgtcctccccgagaactctgtcgtctactttggctctgttgctgctgaccagtacatggacgagctcctcaaggagaacgacaaggctggagtcacttctaagtaccaggtccacggcaaggactccggtctggccactggtaagtgtgctgctctgatcaccggccaggaccgatctctggtcactgacctcaacgctgccaaccacttcgagcttgagcacctcaagaagcccgccaactgggacattgttgagaaggccaaggtctactacattggaggcttccacctcaccgtgtgccctcccgccatccaggccctcgttgagcacgccgctgagaccaacaagattgccatcatgaacttctctgctcccttcctgtgccaattcttcaaggaacctcttgacgctgctgtcccctacctcgactacgtcatctgcaacgagtccgaggccgaggcctacgccgagtcccacgacctcaagaccaaggatgtcgccgagatcgctcagcacatttccaacattgagaagaagaacacccagcgaaagcgaattgttctcgtcactcagggtctcgagcccaccattgttgctacccagggtgcctcccaggtccagaagttcaacgttgttgagctcgacaagtctaagatcaaggacaccaacggtgccggtgatgctttcgccggtggctttgtcggtgctctcgttgagggcaagtctctcgaggaggccatcaaggttggccagtggctcgccgctgagtccatccagctcctcggaccctctttcccctaccccaagaagtctccccagtaagtgagttgctttttgaagactctagaaaacattagaacgtgtttctcaacgaacgcgtatttatttatcgtacataatcaacttagtactaacgttattgaccgagagcttgcagctcacgatgctagcactgagaaattgccgaatgaggcttgatatatggaagagcagcatacaaagaatcttgaagtagccactaggtacgctctttatatatacgagtaaattactcaaacatgggtatgacgtaacacgaacgaaggtcgtctttttcataagcgccatttgctttgtcttgcaagcacacagctaatgacttgcccacgatgattttctttttctattccacctactgcaacgaactgtatcccaaaagtattcatatcttatataattaaccatgtgtcagtgattccagtcactcctgtgcgtgttatgttgcgtgagaagatgagtattggattactccttcttctcatcccccttcttttcatccttcttctcctccttcttcttctcctccttctgcttctcctcctccttcttttcatccttgacctcttcttgcttctcggcctccttcatcttgagatcttcattttcgccctcgggggcctgggctccctgctcctcggcctgctgtcgaagacgctcggcctccctgtcagcctggaatcgagacttccaccatccctcatcgggatcaagacccttggcatcggcttcctccagaccagcaagctcgtcacagtcagtggaccatcgcaagtgcattcgaatgtgctcaatgttccatcccactcgcttcttcttgcccttggtcacaggatagcccagactcaggtacttcttgatcttgcaaacggagttttcatcaccatccttgcctgtgtacacaaactgatagcaccagtccttggactgacaccacgccttgcacttgtcgatggactgtcgaggggaatccttgagaggctcaaaggggggaatctcctgctcgggctccttgtcttcctcgtcatcgtcactcttcttcttagtgtgcttgttcttccaatcctccttctccttggcaagcgaactctcctggccatcaccatcggtatcttctcgctcaatggtccagtcctctcgaacgtcgtcagaaatgtagggcttgacgaagtcgtggtagaggtcctggtaggtaatgtgttttcggaattcgggacccttgcttcgctcatactgccacatgagttcgatgtcacggttggtcagatgatggaaggtagtgatgggctgacaccagttgtcctgaaagaacttgagagtggtaatgggctctccctggatctttcgcgcaatgtaagggtacttgctggctgaggtcatggagagtttcaccttggccttgtcgagcaggaccttggcaaccatataatcaccacagcagacagatgcagtgtgttcctcatattcatgttgcagggtgtcgaaaccatcggcaatctcggcgtcctcaaacatagccttcattgcaccatgagaaagaacaacaccggatccaccgtgagcaaaagtgacacccttgacactggtaggtgagcccatgtacagaggctctttggggtcgagctccttgagccacgccaacatagtatcgaagaagacgtaggtatcgtcatcaatgaacacataccagtccttggtagagtctgtgttccaggcgtgttgcagcatggggatgttcttgtacttgtcgagctcccatcctccgtctagcttcatcgttccaaagtcaacctggttgtgaagttctcgcagcttctgctgctgtcggtagagtcggaagtcctggctgtccatgtactcctgagaggtgttggcaaggatatcaataacctcatagccagcgatggtatcggggtggtcggagtagatggcgaaatgaggcactcgggtgagagttgtgtaagcatgaatcggcattcgtttccaaaatgtggtggctccagtcttcagcatgaggaacagccggtccgatccctcagcaaagtcagccaccagcttctgctgcatgaactcgccagcgttgcccacctgcagaggatcgattccgggagctctatgaacccctcccagagggtatgaggggacgtatccgtgtggtcgccacacgtcatgtcccatgtgtcggttagcgtcagctccagcatggaaagcgtcggggtgcatctcaaaggccacacctgcgggagccgtgggtgatttgggtcgttggcctgcagattgcttttccgtgtcgggtttggtttcggctgtcagttcgattggtgctggagcatcgtcttttggtcgcggatctgagtccactggtgccgagctgtgtgagttccagtctgtatgggctccagcaaactccaggacccgattggagtctccatacagagagtagatagagatggagatgacggtgaggccgaggatggcaattcccagcgtcgcaagccgccgttgtaatcgcaccatgttgtgtagagggttgtgacaagagggttgaaggagtgcgttggatgaagacacgttatcagcccaaaacgtgattgcctctgctcttttggggtggagtaggccaatgtcggattgactttgcggttctgattacttttgctgaaagagagaggctgagctgctgctgctgctggacataggttttagcttctgaaaaaacggaggagatgggtcgcccaccagcggcccattttgtgagccacgagctactagtacttgtagccactccggttggagcctcctttagacgtggatgttggttggattatactgtagcttgttttgcggcttctagcaaaggtaccgcaaaacaaaagttttttcactgttaagactatttcgatacccaagagtcctcttgacacgtcaggctcaagtatatgatgcttggttgcaatccgtagtcaagtcgacttgaccgtttcccccaaaatacacttcaaatacgacaaggacatccaaggctacaaaaacatggcttggaaatcggaactacaagtgtaagccttgtctatcatggtagattcctcatcttcaaacatgcatattttagagttttgtgttcctatttaaagcgataccatgcatgaacgcatgaaacaaactaagaaaagttgtgccttgtttgtccaatttagtaacaagcgataaggaaagggcggttttggtgaggcagcacaagtaagtcgcatcataagaactccatctttctggtgactataatcctactgataaacttttcaaacacgcctggccagaacatcgggaggagcggcatacttaaccttgtttgtgtagatttagaattactactgtagtcacttgtactgtacacggcatgcatgcatgcattgcgttctcgcctataaccacaaacatctggtttttgggacccaaaaatagctcaaaacaccttagccgcctacagcagactggcttgagaaaaaagaggcgagattttgactgcactacttgcatgaacggaccaaccggggaaatggtttctttgaggtatttctgatttcccgccacttccggatggctctctacgatttctggattccacagtgatcgtctcaaacacgctttatcccctgtcttctgcatgcaagaattctttggtgggtaggtaggtagatttacagcaaacagaattgtgaacccagattccaatgaataatgaatgtggaggaagccgcgtacttgtagccatcagagtgtcgtccctaagacctctggaaccggtcctttctttgcagagtacaaggtgccggtacttgtaatatttataacgaaattacctctccgcccacattttcgacctctgatgtatatttgggccctataaaattggctgcctgttccgactccagagtgacgtctgaacccatgcgagtgctgcctggtcttggttcattagcacaagttactaacaagtcgtgccggtagtaattgcccaaggaccccagtcgcctcatcgctgctgacacagatatacctcgtcattgtttgatacggtgcatgcttgaaacactaatacagtagatacatatccgactaaggatgtcaactgtcaaaaaatgatagcgggatgcgggtgaaatgaggacgtggcggtggtgggcttcgcactaataaagactacagtacagtaaaagttcattcgttgttctcgggtcagctgacactggttgcaaatactgactccgtatgatgtttgaacagattttttttggtctcatccgcatcgttcgttgggtacatgcacgcgttgcgccaaggccagagccggtgaaactctccaatctgaaacactgagaaaaacagtacgaggaagaaggaaaatccaaagaacgaacgcatagttggcaatttatacacttgtagtgttggggcacagtatttatgtacaatacagcacaagtatacgggacgtattttcttgcggtgttattgaaaaggtacatggggtactggtagcttcgtttttttaaaaaaaatcaagcaacattttttctcctcgtattaccgtagctacatccccgcaccttttatttcagtatgtatcgtacaagtagacccgttacaacctgaaacccagcagcaacagaagtgacgatatttgacactggaatagtatcatacctacaacagtatgcagctaagagaaattcaaggagtggtagctactatactctgctgaataatgtacagaggtacgtaccggtactcgtatcggtacagtacatacttgcacgacagccctcgtactgtcgggtgtcgtatttttgctcggtaacagtaacctcatcaactgccataggctagcaaaagacttgcggagagcttaccgtgcgggcttggcttttatagcgacctacaagtattggccctaaagatattctggaggcggtttagccggaatttttcacaataatatagatggcttcaggtgattaacccatttcattgtgaatatgtatgggttgtctcgagcaggtacgaatatagacgtttcttgtacttgaatgcagttattatacccacacattgcccgatcagcagctttagatgacgacgtaacaaaaattcaatataccaccaatattagtagcttgaaaagtattacttactgtgtcaaatacctctctcgcttaccccttaaaaatcatattccagggtgcttaaccgctgtaattaagatgtatggaactacaagtacagtgcatagtgtatctctagacgaaccttagaagcgttggttgctttcaggctaaaagctctttgcagtgcaatgtgttgtgcagtacgacttagagcaccattggctttgtgcgagtcgtcgcccctccacagatgtcacaaaaaccacggaaacggctgcatcatgtatcgtgctcgcacatactgtacgctaatgcatccggcattgcaagggatacgaggatacggctgagagaagcgggcatgaaatgttaattataaataaatagggaactggaaaaacacagtcaagtggggttcgtgtgtgagtgtgagtgtctatctagtattcatgggcgccgttgaagtggacgtcggcctccgtacagtgtccaccttgggcggccgaatcaagcgcaaagcagacaaagatggagtcgacaatcatactgagaagaccttcggtactgccaagcacaaaccaacccgtgaatgaggcgagaaccacttcccaaagaagatgtccccgaacccaagtggtggcagcaaacaacagagctgtcagaacccgtactaccaccagcagaagcttcgcaagcttgtgcactcgccatgctgctgcagggagacggaaatgcaagttttgaacagtcagagaagacgactttaggttttgagagttgataacagccagtgtcagagtcagagggctcatagagagcaccccggagggggttgctagaatgtacaatgccggtgacacaacgtttagaaccattcgaagtggccatggcgcgaccaccgatgtcacggtaccactgagagaaactacccgtgacagtagcagcaccggaatgcgaaatgtaagatgcaacaaggagctcagactgatgctgccaaactgagtcgtgagagcatatccaagagctgcagccaagacctggcgcgagctagtgtgcgggaagagatgacggtaaaagtaccactgactgacagtggcagaaatggttgctctctgagtgccgttcagaataccccaggtccacatgtacatgaagatgcccaaggcgctcacaagcatgttcttaccatacatgacttggccgatggctgtgacacagatggccgagatgagcacaaacagggtcatgaaggcaaaggacaagaatacaagcacgtggttagcactgaggattcgacaagagagctgaattatcccgactgcacgcgacacgtaatccttgtgcttccagaatgctagaggccacatggatcccgtgatcatgagtcccaaagtcacccaccatgaataccctcccgaaaagagagtcacgagcgcagctgtccatacagccaccggaaaggctgcagccagaaagtagaacattactgaagagtactttcgtaggagcagcagccagaccaaggagattgcgactgcaaacaccgtgtaatgagctagtactgtcagtggtagaaatgttagagacggagatccagtcggagctcctccatcaacacctcgcaatagcgccaaaagatacgttgcgatcgtcgctgccaacatgaacaggtacactcctccccatacctggtcatattttatggtatccgatactgaggttggaggcgccaactcagggggtatactggaagccatggaatcttcattcagcccgtgttcgggatccacaggcacacctgctgctgctgccgctgctgatgttgatgcaggaaagaaatgttcgccttcaatactctgttctgagtcttcgagctgcttgccaacctcctcaggttgtccgtcttctcggtctagaaagtccacagggaaaaaactctccttgggctgtttgtgtgacttgcctggctcctctacggctctcagaaagctgttgctgggtccttctgtctcgctgtcactacccgagttggagttccaggatgcgttaatcgcgttggacgcctcctcgtcgtcctccatgtgttcccatagtcggcgcggcgagtagatgcctctgtggttgttattgttgtggttggtgtggccgttgtgattgctggattcggcctcttcgacggccgagtggaatagcggcacatttgagtcttttccaaacttgacctggctttgtgtcagtaatttcgatgcgtattcggaaaacatgccgtggtgctttgccgtgggcagagttagcttgagagctgtgagcagtgatttgggcctgctcagataactgataaggttctgatagtaactttgccacccgtgatagcagtggagactggagagccctagagagtaacctgaggaggtgaatatatgattgtagtgtagagtgcgtttgccaatgtgtaggtatggcgttattaacagtatattttcgccttcatgctggtcacgcatacaccaacagtaatgtctcacagagctatctccgaaagcaacgtgaccgaattaacatggtcatgcgagcttgggagagtgatttgaggtggtcatgtgacgatacgcaccagtaatagtcactgttcaattatctaacacataattaatcattatacagtatacagcatatacttccactctctgtataggtggtcgagcaggctacaatacgtgacatgtagatctgtcatctgacatgtcgaaagcggcaggttgaatgtaagccacagtggtgcattgagtacgagtagctacatagcgatattgcaaggggtgacgtagacttgtggaagtaatagcagctgccaatttcatctctgtctatggctgaagagcagggttgtatagaagcatcgcttggagaacctgaggtcgtcacatgagggactagctgaactcaatgttggtgggaagggttgtggagctgtataaatcgatttgtacttgtacttaaatatatctcaacgaatatgttgaaaaaactggagcatgacccaggcagtagggtcacaccccgttggcattctaagactctaataaacgtacaagtacagtaaatacagtactctacgtagttaaaagtaccagtgtataaacatactgtgtacttgacaatacttagagaaacaagtgaaactaatacaatgggttgtatgaacaacgaaatgtgcgacagagtagctgatgtcgtatatacaattatcctgtgttgcatcggagatctgctacatgtccatttcccaatcccctcgtagtccttcatcttcatcttcatctccaccacctaatgcttctgactgcatcaccgctgcaccgtttgggaaatgaaaaggcctatttgggctgtcactagattgactattcttaaagcaacacttgaccaactgcctgagcgcgacccaaaactctggagactacgcaaccagaccaagcagcattatcacatccagcatacgttcaacggaatcaactcatacacgcacacacacaatgagctgggattatattgccaaaatcgtcatgattggagattcgtgagtattcaggggtctaggtgtcccagatgctggttaaaggcgttcatggcggggcgggtggcaaaaggggcggcatatgttgcggtgggtatcatgtgcagcagcctttcgctcaaataacccaccattgcatgtcccgccatacgtcttgccatgactcaaacgcagatatcattcctttctgttaccatactaacaccagagcatgcggaaagtcgtccctgactctaagactgactgatgacacattcagcgagttccatgatgtcactatagccgcggagatcggctccaaggtggtagacattgacggaaaggagaaaatgaagcttcagatctgggacacggcagggcaggagcattttcgggccgtgacccggtcgtatttccgcaacgctgcgggctgcttgctggtctacgatatcacgcgccccaagacgtttgccaacgtgcaaatgtggctgggggagttgcgggatcaggctgacgaagatatcatcatcatgctggtgggcaacaagacggacgttggagcgcgtcaggtggaggctgaggaagcccgaaaatgggcagatgaaaatggtctagccgggttcattgaaacgtcagccaagacaggagaccaggtactagaggcgtatcagcgggtggctcagaagatccactccaatatcaagactggcaagaccaatatcaatgataagagatatggagttcgtgcaacgactactggaggagctcagcagctgaatttggacgaaggcgatgttaagaagagtggatattcagcatgctgctagcgaggtagaggtccgaaacgtgtatatagaatttatgaccatgcgaccagtgcaatactttacactacacagtacaagtactcctgtttcacaggcacctctacagcaactgatatactgtaattagatattcatcttcactggtcaagttgcttaatcacagaggcatgttgttgttctccaagatttactgtagaggcgaaatgtagaactgggtgtgctttttaagtcagagactcttcactgtgatatataatccatattggccaacaaaactacatttaatatgattgaatactacaaaagcgcaagatactcgttcttgaacctggtttcaacaaacacttctgcgaatgtgatattatctctcacatgattatttaagataggaagggtactgtagctgttgtaaaagggtaagtggaaacagttatcttaacagagaatgaaatattggacggtgtatacaatttcttgtattctaatcgtgcctagcaaggaagtcttaaacagggccccatgagcggaaggatctctctgcaagtatagtagacgtgggctgaaacattgtactattagtgcgatttacatactaaacatatataccggtattctatatattcttctgcgtacaagaagtacggggtacactcaaatgtaacagatttgcacaaattatcccacttaaaacttttcctccctccctttgtctaatttcatggtttcattgatctacagtatgattctatctaagcccggttggcctcgttcaagttctcctccttgacaatgtactttgtgggagctcgctgggcccactcggtccaagatccatcgtagacagcattggtgtctcgagaaccaatgccggcaatctccagagccaggtcaatgacacaggcagtgacaccggatccacacatggagatgatgggcttagagccatcaatgcccttggaagcaaacagagccttgagctcctcaggagatttgaattttccattctcgaccacctcggggaaggcgatggagtaagctccgggaacatggcccgaggacagctcggctcgaggttcagcgtccttgcctgtgaatcgtccgttgggtcgggcatcaatgaaggtgacctcgtttcgaatcttggctccgtcaccgttgtgtttctcgacgatggccagcacgtcttcaaaggacttgaccagctcgggtcgggccttggtcaccttgtagggaggatcggcgggatcgatcttaccaggaacttgtgtgtcccagatgccccaggtgtaggcatccggtctgctggggataccagggagctgggtgtaagcctcaaagccattgaggaactggacgttgtcatggccaaagaccttaaaggtccacacaagtcgaggtccggagaagacgccttgtgtgtcgtagaccacgatgggagagtcagaggaaacacccagcttcgtgagctcgttttcaaaggtctgaggagagggaagcatgtgggggaacttggagggggtgttgacggcatcgatgtcaaagtagagagcgccgggaatccgcttcttcatgtaattgtcgtaagcgttcttaccaacgttggcaggggtgggaagataccaggtagcatcgaagatcttggtttccttggaagaaagtcgcttggccaattcggcaggggaaatgagtttcgacatgttgtgtttttgtgtcctgtagtgtatcaattgaccaatatcaaggtgtaaagatgacgatgatgatcctgctgtgaagttggttgggacgccctatgcaactaaaagtatgtctgtggagcttaaacgaaacaagtgaaaccaatgagagcgagggaaaatatgagtttgaacaagtttgattggcggggaatctgtctgtatgactaagcgtattttattttgatatgaaacagtttttttggtgaatattgctccaattgctgtagtttgaacgacacgctgttctctagcaaccccgctcaggcagcagtccatacgcattatcggcagcaacccatctcaatgggtgagtacacaatgtagaagcgatgatctcgtgggttcgactttcgcaaaggtcattcgagacagatggagacacgtgtctttcaacaacttaaacgtgcattctgagtcagcgaagtgattagtaaggtgattacagtcgggtatatcaccgatatatgaataataagactgcatatttgacagatccgagatctaacacaagcgatcggacttttaatgacccgttcacctctcataaacagtgtgcaagtgtgtgagctactgcagctacttcctcttggcacatgctaatcatctcgagtctatataagccgactcaatgcgctgtgattcgtagaagttcaatatatgcctgtagaagtagttggaggctatgaaatcacacacaaaccctttcatttcgctcctgagatatgctgaattaatacatttacccggaaaatgcattgacacatgtcgcttacatatcaaattcagatccccctcctacctgccattggctctactgttcagccgaaaaacctcatagccctgaaagaagccaaatccgaacggcggagagtcggtcgagacccgatatggacgactccccggacataaaacaatcatgcttaatactctactatccatcccttacttgagcgtgcattgagcattcgttgattatgcttataaacgtaaatgtgatatcttgagggctaaacaaacggatctctagcatcggtatcgtcgcagcgccactccacacctgataaattttattatcatggtcctttcatacacacaaaagtattccctctcatatatcgcctcgattgccctccatatcattctcttagagtccaaccctgcggtctagactttcaattaatgcaaccagagttagatctgaaatttcatcggacttgtctaaagtaagcaagaaaagcacccccagagaaaagaggacacgttcgtcggcatcttccggatacgagctacccctcacggcaatctctgatacttgtaaacgtgtcccgcctgtaatgcctcagtgcgtgaactaatgtagatgtacaccagtgcatatctacaagcgtcgatgtttagagcacctataggcatattttttcacagtagatgctgtacacactacttctacacctacaattctgtaattgaaaattccaaataatccattcatgccaagaaatacaagccgatgccaaatgctgtcgtatcgtgtgacgacaacgggagaatgctttcgccaaagaatgagcgaagagcggcacagcgctgtcaagatgtgtttgtgtaacagtgcgatgcgagtccagaaagaagtaaatatatatataatcacgatttgtatgatcattttttggtgtttttttgtccagcaccagagcacgtatgggcggtgctgcctgttactcccggctcatctcagttttcaacgaaggagctcgggtttcgacctccttcaaactggggagaacattgatatcaatatcctgcgaagtccgagccagcggcttgttgctggccggaggaggcatggaattgagagcgggtttgttgacgggtttactgacgggtttgctgatgggtttgttggcagcgccagtgtttccggatcgagcagtgtgggtcgacgtcaccgacgagatggagtctgtccgtccaaacgaagaagttcggccgggggctcccagagagttgcaccgaggcacacctgccgccgaaccgatggagctgcttctctgagctggtgaaggcacaggagtggcagaagtggcagagctaactgtcgctgtgggtgtagcggtactgtgctgaggactatgagtatggtagcccgagaagccggcgaagtggtggccctgatgcaaatgctgatggtttgggtggtgttggaagcttgaagtgctcgcattgccctggttaaaaatagggcttgtgaggtgctgcacgccttggctgacgccctgagaagttgattggatcggcttagttagcttgttgaatagcctccgcccccgactaggcttctcctgtgctggaggcgacttgacgactgacttcatgaagttgaagaaccggtcaccatactccgtcgatggaatagccgagagggcaaatcgaggatgcttgagggacttccagaaagtctccactcgcttgacaaagccgtaaggagtgaggcagtcgatgataccaagatagtagatctcatcgagaggctcatcctcctcgttggttgatctgaagccaccatcatccgcgtaaaagcgcaagctagagtgtctgtgttagttttcgttcatgttagtgttgtagatgttccatccctaataccatagtaatactcactcattgacaacataaggcatatcctgtgtgttgaatgccgtggggctagttgcactaatcaccctcctcagctcatccggcttacccgacgtgttgttagagtccacgggctggaatactgacagcagattgtctcgcagaccctctgtgtttcccctcttcaagtcgtggataccaatcagcaacgagtagtccatgatgttgagccgcttgagaagctccacatcaacttgcagctgcttgaggaactggtctcgcttggtgggacccaggttgatcgtctgcttggccttgatccagttgatatccttgaacaccatggcggcgttctggaggttctctccctgggctagcgcagcctcctcctcctcagtggtagggagaggaacaggcagctctcttccaattgaagagcccttgagatcgaacgtccggtggatatctctgtggggaggaaacaggttgttcatgacgatgaagtggatcttacgaccgaagggcagcttgactcgatgcaggccgtagaactgcgaaatcaaagtgttggggttggccttgacgtggttgtaatagtccttgagtatcttgcgcagctgcttgtgctccgagtgatgaatcgtcttgatgatgaatctgtagtcccgagagaaataaaagaaagatccagatttaccaggagagcccagctcgctgacaatgtacttggaggtcaaggacatcaggtagtcggccgggtccagcttgaacagctctcgcaagtgtcggaaaacccagggagagtagtccttaaacttgaagtcgtacttagccgaaggagtcagctcgttgccaactatatcaaaggccagcttgtgtcgggcggtaaaatcctcgtcagtcaaaggtctgtcgttcttggcgttgcaccgcgaaacagcaacccgtagacccgtcaacatgttgtatgcagtgacgtaattgtcgtggccctcgctcaccttggtgcccacaagaaccttgtcatcctccacaaactcacgacgcttcttcttgtactcacgctgcgcaatgatagagtcccgcagccggttcacctcattctgctcattctcgtccagcaactggatgcagtcggggtggttgtgtccgtgggtctggacaggtacagatcgccgccgagaaaaggaatgcgacggccggtgggcggcgtggggaggatgcaaagtcgcggaagacggctgcgcaggcatgttagtaggaggagctgtctgacgacgggtcatgggtggcgactgctctttgagaagaggcgatgagaagggcgccgaaggaggcaccagacccgatgcgtggttgttgccagcatcagcatatgtctcagcgccagaagagccctgggccggagatgcaatggcagaggggcttttgacggtgttgctggatgtgtcagtcgaagaggacgcctgtgccggcgttgttgtgttggtgtcagtgttggtgtccgtcgtggcgccggtgtcgtcgccttggactgtgtcgataatgcttgtcttgtcggtgccggtgccggtgtcggtggcgctgctcgcgtcctccacgcttagagggtctacccccatctcctcggcgctatggtgcactggtcggtgggtcgcaaagtagcccgctgacacttcggcggcgtcagcagcggtgacattctcctccgcgtcaaagaactcgtcctccttgatctcgggggccatctcatcgtcgttgttgtaagatgacagcgacgacaggtatgctggcgacacgctgttagtgggggacacggtggtcgactccggcgacggtgactgtggctgtgtggtggtcaccgattcgagatgtgtgtgttccagtggcgtagacgatgactgcggctgagactgctgctgtgtagttggagactcagggacgccgagagaatgaacctgaatgtgtttcgggtcgagagtagatgcataagtatgatgtgtgatggtgttggtgttggtactggtgttgtggccatgcttggcctcctcctcctccttgtgctcggaggacatttgcttgtcctcatcctcctgtctttccgaagcactggtcaaatcaatatactcgggtttgtaatccttatctttgtgtttgtgatgcggaatatgatggagagggagcggcacctggctcaccaagttggtcaggttgtgcttgtgtccgttggtatgatgcttgctgtggccatgtgtgtttttgtggctcgcatcatctctcacgtcggtcagcacaaagctttcgttgtcatcagctttgtcggactcccctactcgagcagtgtcggccgtctcggcagacttggccgagtacgccgtgtgagcatcagacgagtcgaacgacagcggcaagacaccactgtgtgcgaccgtcgatgttcgtaacgagtgcggaattttggagatagatggcccgggggggctgtgctgtggagtggccttcgtgtagagactggggtcgtcctgttcaaagtcaaactcgtggtcgtgggttgcgctgcggctgtttgcgacacttgcgtctgtgccacgaatgtcccggtcctctgtctgtgttgctcggtcagtgtttttaccacaaggctcctgaggcaaaacaaacgcttgttgatgatgattgtgctgggaccagtcctgtttgggggcgcggttagggctattgttaacgtagtttgagttcgctggttgggacaatggaaaagaagggcctgaaataccgatgccagagagagacgagataccagacactccagaggggtatccgtaagtcgaatacgatgagcgaatagatggcgctgtggttgtagcgttcgtggtagtagtcgcagccacagaacgtaggtcgtcctcgtagagcgacgacgtggatgaagtggaagtacggggagaataacccgtaaaagaatagtcggaaggtggcgagggcgtcacgttcgagggaggtacgcctgcggacacgaaacccgaggttgagtactgcttctgttgcttgcgggcctgtttctgcgtctgttcgtaccgcttcttgttcttcgcagccgctttggcggcggcggcggcagcagctttagcggactggaactgaggcaacgtgtatggcttgagttcgttcatgccttttcgatggcctggctgcaacgcgtggtggtccagtttcaaggtcgttgtggcgttgtgtgtatgaagcgtggtgataatgtgtgggtatgggcagattgtggagcctgcgttttcgaagtgcatgtcagagaattcggacaatgggtttgtttgggttagggtcgtgataaaagggggttagattaggcttccagtgtgtcacaggcagatagggggttgcttgcctattcggggcgcgtttgggcacagagagttgcgcagataatatctggatactttgctctcatgcagagaagcccaaatttctcacctatcaaggccctcccccattattgacccctattatccccctctccgagctgtcaagaattatgtgcattaactttgtttctgtgctaagccatggactaggttttttaccagctaaccttatgcatcgatcggctgagagacgtagtggtgagggaatacggttgaggaatgggtgtagggttaagggagtgtgtttggcggtggtatggaccatttggggaacttcaatcagtaggaaacaccttgcggccctttctgggggtgttctgaggactccacggccgatattatatgctcctccacctcggctacaacatggaccagagtaataagcttcgatcggaatgttctaaataggcaagtgcactgcgcagttgggagatggaggcaatgcaaagggttaggaatggagaacacgcaggacgtgatttgatcggtttggggacgcgaaaagtggctggtaaggggccttggggggtgtcaatgggaatttttcacccacgcatgtgctcgaggccctcgaaaccccttagaaatacctctcaagtgccgttctcaagctctcctcgaattttctacgtacagtagttactccagcaaccgtttgtatcgaggcatatagataaggtgtgactggaggtcgtcagaaaggagtgccacagaaaagataaaaggcagagtctagaagcagtgtagcatcgcagcagcgatgtgactgcgtatcaactttacatggttgtttcgggcaagggaaaggagacaagctcgagatgcggagctttccaaatggacaaccatcaaagggtcccgtgtcactgtctcaagctcgagccaagatcacgagtccatttagtagaccagaaatcccctagtacctgcccgttggcactactgtggggtgttagtgctgcagccaccgcttcgtgcagtgctgcttcagcttcggcatgttgttgttgatgtatatgccctttgcctttcataagaaccatggcctcattattaccacagccactcacaaggggcccaaaaaggtgggagactcaaaaggcgcaggtctaacgaaggcgtcaaacgtcgccgcgggctccactgttaactttgctgctcttggccatgtgcagaacaatagtttgttgcctggtaacgctagctcggagctaatccgataactccgataatcccggcatacacaatggcgaccaaaactggtcacgtttcccatgaagtcttggttgaaacctcgccacgatgacgtcatttataccggggattaatttccttctcatgggatataaatgttatacatgcagcgagctacgttgttgttagtactttctgtttaacatgacgtcatcatgaccagttgaaggtcaagcgtgtccagtctgtcagtagtgtactgtagttgagtgtggttggaagcatgtgctattttcatgcaccatagaggcaacatgtctctctacattacttgtaggccaactctccgaccggctgtgttatctctggtgcctacgagatgcccatttggaacgaacgttgtttaggcctttcctcaaacagctcgcacatctatttcaagcagccttgagagaggcttgcttaaggcttgttaacacacaggcctgcatagataaaataaccgtaacaatgtaactcgtgagttgactgtaggtgttgccatttttccctgtatcattacttgcaaaagtacatactatattcacccgtgtataccacgacaccatgtcatgtctgcatcaggtgatgaccacacacgaacaaggactcgtacttgtaaaaagggcatgagtttcaaatgttcaaagtcgctcattcagatgacacatgggggcctcggttacttttacatggtggtagcatttctcgcttgtgcgagcttgatccttccttcttgccttcttgttgttacgttcactatccatctcctattataaccacccaattgagtctatagagcggttcgcatagtatttcgacccctgaatgagcaagagcttcggcaacccacccaaagcacatcattatcattcgactctcaaaagtacaagtaggtacttctaaccacttgctgtattaccacaatcaacaccaccaaggctttaacctgtgtgttacggtaaactacttgtagtattatcatcatgaagttaccatttgtctcagttttgccagaaatggaggcaacttctagctaagtatatacgatcagccactcatgtcttatcctgtagataagccacttcaggtaaaaacacctccttgcaagcacagccttgttaacagcgctgccgcactacagtttgcgcttgtaggtcgcgtaaggaacgctaacaacctgtagcttttggctttgatgctaacagtagctacctgatcctgccgtacccagccttgtttgatatcgacagaattttgaaacgcccagaatgttgctcttattttacgcgagctcttttaggctggacacacagcctctcgatcgggtcttgatttgaggcatatctttggccgtgtttcaaaatacattcggaggcgtacatgatgaaagagcgattataatgaactggatgacattggaagtacatacaatagtgccttgtaaggaaagtggctcaacgtcgagctcttaacaccagacgacagcgactccagtgtaccaattaatcgaaatgcgagcatacatgatatactgtaccgctaattacttctacgatggcttacgtctgataaactaagaagctacaagcatatccgttaattcaaataaaaaacacaataaattcatctaattaatacaaaaaataaccgtctacaatcgagactcaatcataggatcaaatcgaaggtcccagaccagctccaaaacgtcccacatgtacttgacataagaaatctccatcttgtcaagaacaccgccgtctccgccctttcgctgctcctcatccacgtctcgtttgttagcaagaggcagcatgattcggttgacgccagcaagatgagcgccaagaagtttctctcgaatacctccaacaggtagaacacggcctcgaagagtcatctctccagtcatggcaatagaaggagggatcggcttacccataaacagagacacaaatgcaagagtcatggcaactccagcagaaggtccatccttggggatagcaccggcgggggcatgcaaatgaatatccaccttgtcaaagtcggtgtcgatatgcagagcagcagcattgctcttgacccacgaaagggcaatctgcgcagactcctgaatgacatctccaagctttccggtgagcttgagctgacccttaccgggcatctgggtggcctcaaacttgagaagacctccattaccagtgcccatgtaggccagaccgttgacaacaccgatgtgcgacgagttgggctcctccttggcgtcctgagcgtcctcatcagtgtaaacctccattccaaggatgtcggtgagattctcaatggtcaccacgggatcgtaggacgagtgagcacccttcttggcctcgtctacaacagtaatcagctcaccgtcgtcggcggagagagacttggcgtagtctacagccttggctcgacacacagcgccaatctttcgctcgaggtttcgaacgccggcctcacgggtgtacttagtgcaaatgtgaagcagaacgtcgtcgggaatgacaacctggtcaacctcaagaccgttggctttagtctgcttggggacaaggtacttcttggcaatatgaagcttctccatgtaggtgtaaccctccaggtgaacggtctccattcggtccagaagaggagcgggaatggtgtcgaggttgttggcggtggcaatgaaaatgcacttggacagatcaacggggaagttgatgtaatggtctcggaaagtagcattctgctcggggtccagcacttccagcatggcagcggcagggtccccgtggaagtttgcgcctccaatcttatcaatctcatcaaggagaacgacagggttgttcaccccgacctgtcgaagaccctgaatgaacagaccaggcatggcaccaacgtaggttcgtcggtgacctctgatctcggactcgtctcgaacacctccgagagacagccgctggaactttcggcccagagctcgagccacagacttggctaaagaggtcttaccaacaccgggagggccaaccagcagcagaatgggggctcggttggagtagtcgatgggcttggccgagtcgtcaagctggccgttggggccctcagaagaagcagcagcagcagtctcctcttgagcaacctcagactcagatcgcagagacttgagtcgcagaacagcaaggtactccaaaagacgcttcttgatatgagaaagaccgtaatgatcgttgtccagaatggttcgagcctggtcgactgtcacaacagtgtcttcggtacatttgtcccatggcagctcggcaatcgtctcaaggtaagttctgcagacttggtactcagcctgagtgggaggcattcgcttgattcgcttgagctctcgggataccaccttgtcggcttctgggctcagcttgaggctctgcagcttctgggtgagctccttaagatcatcgtcctctcctcggtcgtcggtctctccaagttcctcctggatggctcgcatcttctgtcgaagtaggtactctcgctgttgcttgttcattttggagtccacggtcgagtcgatcttctcggtgatcttcatcatgtcgagcttggtcttgagaatctcggagcccttggcaattcgctcgggaatcgagaaggcagccagaaccgcgatcttgtcctcaaagtcggtggggagaatggccatgagcagatcaaccagcataccagcggtctttcgggtatctcgtgccgatccggggttaggacccagcttggtcagctgcttcataacagaagcggccactgtggtctgcgaagccataagcttggagaactgcgtggcattactcttggcggccagatcgataatttccttagcggaggcgtgcaacacctccagctgcgacaactcggtcttgctccatgtgggctccttgtcactggactcgtcagaagaggcagactcaccgtcctcgtcaactcggaccttgattcgagctgtgggcactagaccggacttgtcgaccagctggccgagctccaaacgggacagaccctccacgacaatctggaagtcctcagtaccagatcgctcaaaccgcacgattcgacacacggttccaaaggagtagacagaggtattgacctcggtggagttggtgcccagcacgggagtcacgctctcactgtcgtgggcaccggcctcgttgttctcgccggtctccttgatctgcttctgggtaatgcggggtacgcaagcaatggtgatcagacttgcgtttctgtacccgtcagcagaagttcgcttgagtttgaagaaggcctgcagcttgttgacactgctcattaggtcttgcgtggccttggagtacgccacgtccttatctttgggcttctcaaacagcttgagcatggccacagcggtctccttactcaagcccaccttcatgctcacaccgggcagcacaactgtgtcggccggcagagtcagcagaggtagagttgcgtccataatatcgtagttttgtgtaactagtgttgtagtgtcgtagttggttctgtacttcgacgcctgatactcactgtcgcgtggtgtcgtacttatatgttccaaccgaggtagtcgataacaaacccaaagcaacgttctgaaactttaacgctctgattcatgtgatagccctggaagccacgatgtagagttgataggggtaacgggggatttgcatagatcgtggataccaaggggtctctacgagccatttccgggcggtttttagatccaaaagcaaacattgtagtacaagtttagcccgcaatagacggtggcaaacccactgaagaatgcctaaagcacaccatcggcaacctaacggagctgcatctgagatgactttcaagtccgcaatattttggagcttgcagaaaaataaacacaaagaaatgcttgtcccgcccgtgccatttcagaaagcttctcaagttgtctctcagcccgccattagtctatctacaacgccaccagcttatcgctcaaagttgggcccttcgaaactgtatttgaggggggtggtgaggatgtccgtagattttgagacactaagcgagaaaaatttcgattcggaataatcggaatagcttaagagagaacagagaaataacttgagaattatttttttgtgtttacagcctccccatcacaaaaatacatcaccttggctcttgtactttgctcccgaccttgcgtggtgcatgtactgatttgcagtgcattaaagtggggagagggtgcaggcagatgagccgactgcactagtgggctctttgttggactagcgcggtatagttgaacttaattggagtttttaattgaacttccaactaaacggctaactaagggtccgagacgttaactaaactaaacagattctcatggggtaagaatataattgacgttccgacggtagagggaacagcactgctgattcatcggtttaatagagactctcacatcaaccaacaccagcaaccgagtcaaacaacttgtctcaaaatcctcgtaaccataatgctgagacctagctcaaaggatatcttcaaggcgtttttgagcacttatttgccaccttccgaaggaaaaagaacccgggtatctcattaaacgatcccgccttttccttgtcactttttttcccctttcaggaagccgtagccttccattactgcatgcttatccctgcactccatctacttgtagaaggttcacgaacacaatagttgagtctcggaaaaaactcgaccaacaaatactgtattagtcccaacctaatcaaggtcggggttctagatgcttctgacaacaccatcacctgccacaccacatcaaggcgttgacaacataatgccaacatcacaagactgatctgattcaccccgagaaaagatatccagagctagattccccacaaactcgctaatgcacagaaatcacgcttgacatgtgagtctaagtgaatccatttgaagaggaccaccgaggtacttgtacttgttgtactcgcagtgagatggataacgcacgcaagcaacaagacatacacagagtatctcaagatctggttgcaatggcatctcaataactgcactacttgcactatctctacgacacaaacactaggcaatacccactattcgagatacctcctcataaatattcttggtgggaagcaacgtcgtctccggtggcgtggtgggtgtcatgacagtgtagatcaatacaaccaatgtcccaggattctttcggtgggtacgaacactttgggaaaccggcggcgtgaccatcgaaagttcgagagagagagagagagagagagatgtcagatggagaaagccggagttcaatagttgggggtaagctgtaggcaccatctgatagttgaggttaatgctaccaaaaaggggcttggaggggacaattgagacccgagtagtcattccagaacgcttaaagggagtggcgacacttttgtgaaattctgaatgcatcttgcgacgtgaatagttcaccgaagtaaaacagtgatagttgttaatgccagaagttcaaatacttgttctattatttactgtaacatctatatttcctttttcttagcatgttgtagcggcgatcacccttccaacatttgaataatccaatctcagttgatagaggaaagatacctttttacagtaacaacttcagtaattacagtacatacagtaatatatgctgtatagcctactctacgtatatataattcgtcagacacaatctacaatctcagaaagaggggagggacaatggtccaaacgtatttacccgagaggttctgcttaatgcttacagtatatcctcttactatatatctatcaaagggtcggctggagagatacctaaactgtggaggttccacgtcctacttcctttctgactgcgagtcagatctacagaactccgactaccctgaatgctcttgcggcggctctggatcttctgtctgggaatctggcttttatcccaacggtctggcttactagcacatgggttctggacctggactctttgagctcctagtggcactgacttgtttcagcccgattctcgtaacatttgtagctcctattggcttcatagcgcttagtggctgaacaaggtgttgattcttacagattggcactggcccatatcatcactcaaattgcgatgacatcatcgtataaccgaattcgtgcgggcctgacttaacgtatcttagtcaattaaacgtctccagctcttgtggcaggtggatctcaccacaaacagctccagcaagctttttagcgttgccagaattgagtgtttgtgtggcatcttgtcggtcggaggctctgaagagatctttactctggtggtctggcaggattgatctaacgctaaggcagtcttgaaaatacctacaccagccaggattgtctcaatatcttatcgcccagcatctcccgaaaacagtcgagtgtatggacaaataccatggtcttctggtactgtcaatgaggagcatcaaggatggggggggggggttgaactgctcaaatataccataaatattgtgtttttgagtttggagattttcaaatagggaagtttttaaaatacctaacataaataaggactagctaaatagatcaaaaggtatagagagcgtagccgagtacatacaattgtacaacaggttcacaacgacgaagaataaaaaagtatgagagctgtgaggttcgaactcacgcctctttcgagactagcacctgaagctagcgccttagaccactcggccaaactcccatatgcaccaagtctgcaagggacgatctacgggggaaaaaaagtcacgtgagtaagtttttttgataccgattacggcacacccaagtaattaacaacaccttaagtggtagcatacgagatatatatacctaaaattacctataaatgttgttataactcttcatccacaaaactgacacttctggagcagtttcaatttttgattacataatacgacaacacggaagctaaattaaatacgagcatctacaaactgagacggctatgtgtgagtatgtcgctactcgtgctactactgtactgtacttgtatttttcctgagaccaaaactgggctatttcggacttgctgacccacctcaggcggtttgggggctctgtataaacttgggtcagtggatactagtcgactcaaaaacaacgagtaagatataaagagtgaagctatccgcctttcagccacaggtgggattattatcccagaaggcatttctcatgcccagtatttcttatcagagctgtattagtatctgatgacactggcttgtttctgtgttgtgttgtatcaaagggatatacccatgcacagtaaggacgactgttacgagtaataatagatcaatgaaataaataaataatgtagatattcttagtaactcccatctataactccccatccaattctcttgcctcgaatcttctagagggtagcaacagctcgtcccaaatatctgctggcagatagtcaccttgctgggctacaaagtcttgacgtctattagtctcctggatactcatctgagccagcttcgcgttcacctcggtcacataatctttcattttggcctcggctgcatttcttcgttctgcttcgtgcaatagggccttgtatgagttcaagaaagtctggtaatgcgtcacaacagctgatgtttcactcacataccgctgcaccttcagaagatactcctttgtatccctttgttgagtctcacagatctcgagtgtagcatccatggtcttctcgacagcttggatgccctcgagctggcgcacttccagcgagtaggagtggtacatctgagtcatgtgattgtggacaccttgacatccctgcttgacctcgtccaggcgctcttgtagctcgtccaacacatctggaagttgttgagcgtcgttctcaagaaccgcgcgcaactcacccagctcattaacgtcctctgcctcgatagcgccagtactcagatcctgccctcgttcacacaagtcgtaatgtcgagctagcgactgtaataggttagccatgtcttccgaacatgcttctgccgaattcagcaagtcgtagatgcccgaatctgatgtttggtggatgagaagttcggtttgttcagccttctccctctcaaactccttcttggaacgattcacaatatctccgtgtctctgaatctctggcaacagcactcgaaacacattgagcgcctcctcatgcacttcgttccatcccttgccttgaacctgagcggaaatgagatcttcgtccacaaactctctcagattgtgagccccattgttgactctcaattgcacaggagttgcagccaactcgcctagagcttcctccagagctcccctcgctgcctgaaaccgtgtctgctgccgggtaaccgtttcgagagacttctttgtgcgtgtgagggcgttagagtagaatttcgacgccagcgtccattgatgggcgtgtgccttggccaggaattgtgtgcgaatgccaagatggactgcaacctccaaattctgtcgtgcgcgtgccaagacgtcctgtgattcttgacacagtggccctgcagccgccagagcgtcctgggcctcccgaaatagttgttccatctgtcgcgtggtgtcggtgataatgcgtcatggaggttaggtttacatgcagcgggggagatggctgaggagagaggtgtcaagagggggaggtgacaagagaagaatacaagtgtgatgaattcgtcgagtgtgtatatgagtctgtttatctctgtattgcgaataactatcgaacttctgcctcgcaaatatctacgtttcattcagtactttgtcaaaataattttcaagtaaacgtcactgattagttggatatattacttgacgattttattgtttcaatatgggggtttccagaagcacgtttgtaagcagcaagccgattataaactactactctggttaacatgtatacattgccctaccagtgtgctaaaatgaatacatctatctcatatctacctgtacttgttgttaggtctgctataattgttgatttgttttctacctacaggatgtacattcttcgaagtgcactactgtactcgttcagtatatattgcgaaggggttattctatgtaaggtttattatcttctaatctgatctttaccctcagctatttttactcctttttatggaaggggtaatctgtgtatccatgaggaccgggggtatagaaagagggtctatcccagtgggtcagagggaggtcgttttcaagacggtagacgagatcagggtttgcaataaagtaccgtccaaaaccaatcagcgttctgtcatcctcctgagcggtttcgatggccgtttctctgttgtatcctcctgctcgaatgaggtctccggtccagatgtttctgaaaggatcgttggattgccattgcttgggaatggcgtcagagatgccgtcagcccgaggctcaatcacgtgaatgtaagagaggcggttcttctcattctccttcgcacgtttctccagctgctcaaacagatatttgaactgaggcagagacttctcctcgttgacctccatgtcctggaaggtggtccagggtgaaaatcgcacgccgacacggtcggcaccgatagcagcagacactgcatcaataatctccaggctgaatcgagatctgttctcaatagagcctccatactcgtctgttcggttgttggagttccagtggatgaactgatcaggaaggtacccgttggccgaatggatctccacaccgtcagcaccagcctcaagagcatttttagcggcgtctacgtagagctgcactttctgtttgatctcaggaatagtcagagctcgcacatgcttggctccatcttcatctccagcttgagcaattgcagaaggacccaccagatcatggccagtctgttgaagcacatcgtagttggctacacgtccaatatcccacaattggatgtaaatcttggaccccttggaatgaatgccttgaatcaccttcttccagcctgcaatgatggaggcgtctccccagataccaggaacaagaccctctcgacccttgtggcctccagcggaaggatgaatatatgtggcctcggaaatgatgagtgttccggctgtggaagctcgctgggtgtagtactcaacggccagatcggaaggcacgtgtttctcggctctggttcgagtaagaggagccatcaccacccggttagacagctggctagcaccgactttgattggcttgaacaggtttggagtagtcattgttacttcaggtcggcaaaaaatggtgtattaagattgttgcaaggaaggacaagccacagtgataccatcttgggcagtcttgcttcgttgtgcagctcacatgtattgcgcggttagtgggcgttatcggacgttaggtacagtaagcaaattacaggagtaaattgaggtcaagtgatggcagtccaatgatgtgatgtagacttcgctactggatataatacaagcccataatccctgcagaaggagtatgagatatgagttacagtaagttgctgaatcactgtggatcataaggtacaagaacaagtgacataacgtttctagagcttaccagtgatgagaagatgtcgcttatgacgctgaccgatacccgtactcgtaagagtacctgtacacccccaataggcagggtaggagtaccagtacgaataccagtacatgtactcgtacggtacaggtacttttagccgtacatctccgcgccaaatctctcagcaacactatagaaagctggatcaaacatactgtaatgatgatactgtcctcgcgggcgacctcatcgtcaacccttctacctcttacgtaataataaattagctaataaattagaacgtacgagactacaaatgagctgtgctagagaaccagggtgaagagccagcttcagaaaatagtggttactgacaacagccatgtagctacaactacgcaggcaatacctggcacaggtactaaagatagcctggcaagaaccaaggaaagggtatctctacagtaaagccggacccataatcacctatggggtatcctggatggttatgtaagaaaaggaagaggagaaaaacaaaaacaaagagagaaaaagaaaatgagaagccggaaggtgcagaagatgtaaagacatgaatgcagagaaatgcaatgatgtgtacacacaaatagaatataatgcaaaataaataaatattttgagatcatgactgtgtcacatgagcaggattgaaatcaaaactcgatcatcacaaggaaccgccgctttgaatgcggacgggagagaggagcactgcgaggcttggagtggtaaggcgcggaagggtggggcgcggaaggcgcacacgctgtgtgtggaatgatgcttcgcaaagagaagcgtctacaaaagtaagtgggtcaaaacaaggatgacatggaaataccgtcatgctcaacccttgagattcgccagctggtccaaaatgttcttgacgttctggccgggatcggcagaagtgggaacaggagcagcaggctcatctcgaccagacagaggctcagacacaggcttgcgatttgtgtgttgagcaacataggctgatggttgaggacggttggatacagggccatatgggagggggcccgaacggccgcgatcgttgttacgatcattgttgctgttgttgtttcgatcattgcggttgcgtttggagaaaccgttcttgttgccaccgttgccattgtggtgtcgaggaggcttagcaggaggtggcgacggggagggaaacaagttggggattgtatttgacatgaacggcggcatgaatgtgctctgctggggctggggctggtgttgcatggcggcctgctgctgcagcgccagagccactttttggaggctcatggtatcaagacggttctgaagagccatgagagtcgccacctgatcgttggacagagtggggatgcccatgggcatccccattggaccaactccaggaagagccatgctcgcgggattgggaagaccaccaatgccagggatggcaggcattccgtagtatccgttggttgagatgggctgaggcgagctcatgtgagcaggaaccacagggtgaggctggaagttggccattttctcacgtttgactcgcccgaggagctcaatggcgaccggaatgtcgaccatttggtactcatcgaatcgaacaccgccatcgggggctgggtggaatacctggaggttcaccttgttggcctgctggttgattcgctcgacaatgatcagaccaaacacccgctctcggatgagctggttgacaatgtctggaagggactccttgacggacgtccgtggctgcaaccactggtagttgacagacatgccgttttgtttgagagggcgttctacccggtggacgaaatctcggtcaacacgagattccatcacaatttggacctcgggaataatgtgaggcttcttacgagacaggaggtctcgtcgtcgcgaccggccccggtcgctgttgcggtcaagatcggacccagccggagaacggcttctataccggtcaccgttcttgtagccagtcggcgacacagaccgacggcgctcccgattcttacactgcggttgggccacctcgagcttgaggtaaaatccccgcaggtaccggccattctcgaccttcatggcacgctcgcagtcttcgggacagaagtattgcacaaagccgtaagcacgtttgatagagatctgggccagccgtccgtattgattgaacagcttgaacagctccatggtgtcgatacggtcgccgggaaggttgccgatgaacatccgcgagccgacagggaacttgtcccagttgcccgaggtgatgtactcggactcgacacgtcgatattcagagaactgggatgcctcctcgggggtgagtggcgatttgatttcagcctccgacacgggctccgtgggcggcacgtcgtaaccgccattggtgccgttgatgccattcgagccgttcgagccgttggtgccgttcgagccgttggtgctgttggtggcatgtgacagcggctggaggatgcgttgtagagagtctgcagcagcagtttgtgtgttattatcgtgttgttgttggccactacatgcacgtagcaagtcgtcgaggttgtcaacgtttgtgtcatttccgtggccgttggtgtggccgtttgtgtgtgtgtgtgtgctggtatctttgttgtctgtgtttgagtcggtgggttcgtacttggggctgtagtggtcatcatcttcgtccagcgacgacgatgatgacgttgctctgtcagcactcattatggattctgtggacgtcgacgttcccgaagacgaggccgaatccacgcctgaactcgaacctgagccggaaggcgggcgagagaccgagttttgaggcacatcaatctctgcgttccctctgtcggagtcgctcattatatataggagcagttgcgggcaacagaaaaatgtggcagcacaactggtatgtggtgggttgagtaaacagaaacgtaactgcgtatggacaagagtactcgaagtggacaggtatactgcggtggacaaatgtgtggacaggtgtactgtagtgagaagaaaaacgtgtgtgcgtggacgtggatgaggaggaagaagcgttgtgttcttttgcttccttcggttcttaaaagacaaaacagcagcttggggggagcactgtgaagggtgccttgccgattagagttacccccgtaaagacttcttgcctattacccggcccagcatccgaagaaacacccaaaatgtgcagtattatttagagtttcataccatgggaccaaaagacagccgagtaaagcgaaggccaagagaaccacatccaaggtaacttttaacagcaatgaaagagatctaaacaaatgaactagctgtaactatctgcatggaatatgttgtctttggctgacctctcaaccccgttaccaacagcctacagtgcccgtatctacctatacccgccatattcctctcaaaggcctattatgttcaacgtttcacgtttcacggcagtgatcatagcaaagataccttgttcattacaaaccagaccagcatgtacttcgggcggaagtaccaaatctacttgtacatactgtagccgatcgatcatcaatcctatagctgagtgagggtttaatagatgggatatactacttgtagttcaggtggtacaagtctgttatgcaataggtacactagagcttttctcgccgttctatagactatatacaggtacatacgagtagatacgccgtcctcaccactagctggacggcccctccaggctcatgtggcatccttaaagtagagtatttttttgcccccgacctggaccaaaccgcttgattggtcctttcgatgcagccaccgtattcgcatatattcgcatgtaggctatcgcgccggctcatgtctacagtaggcgaaactcgtgatacacatacgcattctatatacagaaacgagttaaaacagcataaagcaggtccatggcgtcacccacgaggtttagcatcgtttcgactgtcgtctgacagaatgtgggctgtcaaacgaaacgtttctccacaaaaccatcgaataatgaagaatgtaggccgggatttaggttggcaaccgataaaaccgaaaaagtgagaagcatcaaagcaagtctttctctccgatccgtcatgcgtcttacccttccccgccgaagcggactacaagcacagtaataaataaataatttattgcatccatgattatgtaacgcacttagattcccgccagcgaagttccacgagaaggtactacatgatgagtatgtaatcacaactctcacagccatatggcgattatgtaatcaccgctcctcacttgcttcactactccaaatccatactcatatcgccatcatcgtcggaaagaaaccgtcgcatgtgactgctgctgttgccaatgctgcccaggctcacgttgccaatgctgtcgttgccaacactcacatttccaagagtcatgttgctgacgttgccacgatgcgggttgatgggtgtgttgccaatgttgagttcgcgagtgttgttcgtgatactgctgtcaagggttccgttgaccagaacatcgcttccgtcatcatactcctcctcagccaagaagtcatcctggtactctgcttcatcgtagtcatcgtagtcatcgtagtaatcagatccctccgggacatcatcatccagatctcgctcttcaataccctgatcacctccttctccatcaccggacagcacatcttcgctgacctccagaccactgaactccgtgtttgtgtcaagtgtgagatgcgttctgccagtgttgtctgtgggctctcctccgatttcgagctcttcttctaccaccagaaatgagccctcttcctcctcaaattcgtcgaattgagtatctgtctggttgttctgtggtgagtcttcctcctcgtcttcgtcttcctcgtccagacatgcttgcagagtcttggaaaaccctgggggtttcagatatgtgtatccgagagtgcggatgttacgcaggtacaactgccgcatctcctcgtcacgctccaacgaccttgtggaggccatgagattggtgttctcgtctccccaaggctgatccactagggagctagcgagaagattggagcgtcccagggtgtttgcagagatttgtggcgtagatttcttcgaatttaatggcatgagagcatgtgcacgaacatatgaaggtctccagatgtctggattgactcctaatggtggtaagttcatggtgtgtgttgaggaattaagaggttcggtctggaactaagctgattcaagttgtcaagttagcgctgattaagtgtctgttgaaatctgaatgagtttgattagtaaatagtgtgataatggagttgtgccgtgtgttgtgtaatgtggtgatgtgattgatgttgataagtgtaactacaacgactgtttgcaaagcttattttatgattaaattgtatccactttagttgaatgaacaagtagtgtgcgtgagtgtttacttgactggggtagttagaaagtgtataaaactgactctctctctctctctctctctctctctctctcgggttcctacttttagcgcttatatcgttctgtttcactcatacccaacgctgagacaccactttagcaaagcagcaagtcaagacattgctcaataataaaaagaatactcaattactacacggatcagcttcaatatttctactcaccttacctatggcacctcaaatcaaaatcaccccaagtaagcatcagtccctcgtctcaggatggtcccacattagaatagagtgtcagatcattggtcacttgaggatgtcaataatcattagtgttattagtaagaataaatgttgaaaaaatgccacaatctagctgacatatttctaacgtcatatgacaaacgtccgccctctatatacaatacctcttagtctccattatcgagcttcgcatcttgcccatatccatatcctctttgcgcccaacctaaaattggacatcagctgaaatcgaacgtggagccgtccacctacattattcgtttttcttcaccctgccgtccattggataccacactacgtgcgaaacgacctttgcggccctccaaaatgctgctatcgaacgtagcggtcaatcgtacggttgtccacacccagctcgtgtcgggaagccggtccgctcttcacgccctgtctcggacatcacactcagtgccagtgacacacacccatcaacggagacacatcttttcacacaaacgccggctgtcgtcctcgaccctcgcgatcccgttcgctctcagcaacactaactccgccacaaccgctcctcttcagtttctctcaaatgtgtctctttgtcgagttactccaggaacgatcaccactagtgctaaagctaccgcccccaatctcgacaagatgagcgccgaggcggccacaacagctgcccaggcttccgcaagtccggtggaagactcctttctgaaaaaggccgtttcgtgccagtcggaaacagaaagagaagccgtcatggcagcccgagcagcaaaaaaggcccttagagaaaccaaagaaacatggtgggcaccctacgttgccctgactaaaccccggctgaccgttctcgttgttctctcggcgatgtcgtcctacgcactcactccggaggctgtttcgctgactaatctactgttcctgacggtgggaactgctctctgttctggatctgccaatgctatcaacatgggacgtgaacccgcttacgactcgatgatgactcgaactcgaggtcgacccgttgtacgtggtgcagtcaccccaaaccaggcattcacctttgctggcatcacaggtaccgtgggaaccgcggctctctattttggagtcaacccgacagtggccattctgggtgcgtccaacattgcgctctacggaggtctatacaccaccctcaagcgaaaacacattattaacacgtgggtgggagctgtggttggagctatcccccctctcatgggatgggcggcttctggaggatctcttctgcatcccggtgcttggtgtctggctggacttttgtacgcatggcagtttccacatttcaacgccctgtcgtatagcatccgagacgagtataaaaaggccggctacgtgatgactgcatggaagaatcccggcctgaacgcccgagtcggtctgcggtacgcactgctcatgttccctctctgcgtcggactctcctactacaacgtaaccgactggtggtttgttctagactcgtcggtgctgaacgcatggatggcatggtgggctttcaagttctggcaacaggagaacgtcaacattgccctggctgctgcaggaaagcagtactcacaaaacccatttgcccggaaactgttctggggctcagtcgtgcatcttcccggtgtgttgctgctggccatgatccataagaagggccagtgggattggttgtttggaccctccgaggatgagaagaaaaagactctcagcagctaatgtaaatatgtatataggtcgataagacaggttctgattagggagagaaggtgtattagcggagagtcgtgatacagtagctggagatgatattgtaatcacatgctccgatatctgatggtttataattacagtcaaagatatcaaaacaatcattcaaataattcattggtccgcttgaatgtgtcatcttctctacaatagtaactttggcagaatattgttgcttctacattgagtatttgcttcaccgcccttattcattccataacgtcattataattatatgcactttttctccgttcaatctttttgctaatcccttaagcaaaagcctggacgccggtcatggctcttcccaggatgagagcatggatatcagactggccctcataggtctggacaacccacaggttggcggcaattcggccaatgtggtactcgtcagaggcagcgttaccgccaaagatctccatcaggtttcgagcgccagcgagggctcggtcacagttctgtctcttaatcatggagatgagctcgggaggacaattgccggcatccttgagccggccgacctgaatggcagcgacctgtccgtaggtggcatcggtcagagcgtcagcgagcttcttctggatgagctggtacttggccagaggctggcccttaaactgctttcggtccagagagtactctcgagcgagcttgatggactcggacagagcgcccatggttccccaggcgataccgtatcgggcagagttgaggcaggtgaaggggcccttgagaccggtcacctcggggaacatgttctccacagggatctcaacgtcgtccatctggatcataccggtgatggaggctcgcagagcggtcttgttcttgatggcgggagtagcgaggccggaggcgacctgagatcgctcgacaaggaagcctcggatcttaccgtccaacttggcccacacaaccatgagatcggcaataggagagttagtgatccagttcttggctccattgagcacaatgacgcccttcttagtagggtgcatcttggcgacggtctccatggatccagggtcggaaccgtggttaggctcggtgagaccgaagcagccgatcatctcgccggaggccaatttgggcaggaaccggtccttctgctcctgggatccaaactgttcaatggggtgcatgaccagcgacgactgcacagacatggcagatcggtagccggagtcgaccctctcgacctctcgggccacgagaccgtaagcgacagaagacatgccggggcatccgtggctcttgacggttgttccgagcagaccaacctcacccatctgcttcatgatgcttcgggggaactcctcggttcggtagccctcaagtaccttggggtagagctctgtctggcagaagtctcgagcagcctcagccacggcaatctcgtcctcggtgagaagagagtccagctggaagggatcctgccagtccatggcggctgtggatcggttgacggaggaggtagcaaagcctcgggcagcaggtgccaaacgggagattctggtaagcattgtgtgttttgtgttggcgaccgtggttgtgttgtggagagaaaggacgtgttggatcacagctctgttatatagttacttcggagaggtgctgtgagaatagagttcccgccagctttgtgtgtgcggcacaaattgcaatgtgaacaagctacaggtagactctggggaagctgcaggtagactggcgcgtagcagaagggaatttataccgccaacagttgatggaaaaaaacccggggaatatgttattttcaataaaagccgcacacagggaactacagacgctgaaacaagggacacggatggaaaacgttggattctgcagtgtctagaggggtatatataggcatgagtcagagtggagctttggattgaaaaggagctcggtgaaatcacggagtgcaagagagcattgtaatgagaagttttggagtgtatttcgttagtgtactagtgccgtgtgctcttgtaatctggactgctcattttagaccctcggtaacaccactttagacacttctatgtccaccctcattatatatcgacctatatacctctctcattcgtcgttgtctgcatcatgcaccccacctcgcgctaaagtgtccagtgcatgagtatacaataagtgatgaatagtgggatgctgtaaatatgggtttagggtggtctgtggaggatctgacagctgagtgaatttttagaggctgaaatactcgacagtggaatatcaggcaaaaaaacattcctccaacagtatatctcatctcctgaaaatctccttgaaagcatatctcctcgtagcttgtagttataattaccgtgcatacagatcattccaacaaggaggtactatctcggctatgaggtggactatcagggatcctgaaagacaatggatttgttaagggccgaaatgcatttagatcaactgttgactggatagctcagggggaaaaattggtgtcattagaaacgtgtctatgtaactgttcaccttgctatcccttgttcaagctgtagagcagctttcaagacaattacaagagagatggagagtatttgacacatccagatgctccattggtttgatatttataattcaactgtgtatatcactatcttgaggtgatatattgaaacagctgcgttcatttcaatcttctcacctctctctgtctctacaacagcgatacttgtatgagtttaccattggcactgtacgtacgatatacctttacacttacttttacagcataattacaactcataatatgtcagatacgttcactcgaaaagattttatatggagtctccatggtccgatcagggattatcccaacaaccgattaacgaacaagaccattcccagagccgagtttccactcgacagggctgagcagactgttcgtctgacccgactagtggtctgtccaactcctctgatggccagattaagcaacggaacctctccctggctcatctccgacctcaaagttgacatttcttctctccactcgctcggagtgtttgcccagactcgagaaggcaccataactggtgcctcgtaggtagtattgcgctcgatttcacggatcgtgcgacgtgaaatagcattgggtatcgatcggcggaaaaaggtgcctcttcgcgccttggacatcttctcctggcgtttgcgctcggcctcaaccgtttggtacaaacgtgcctttgcggtatcacctactccgggtatctttctgcactgagatctgagacttcgtgtccaagtcttgcacggtagaggaggtgtgttcattgtgatgtggtagttgaaatcctgaatttttgcagacgaatgtggtgattaattctagccgtatccaccaaatcggtacgacaagctggtgttaagcgagcacaaaaactgtcaacagcagcaaaaacaaggtggttaaaaatcttagtggttgtggcaacagtgtacgtaggggtccaacacaaacaccatgtctgtcagcccaacaaggttcttgacggagaaaaaaagaagtggacgagaccgggttcgaaccggtgacctcaagcatgcaaagcccacgcgctaccactgtgctacacgcccaaacttctaaaatttcgggaaattttgaggtcacaattgtgaattatgtcaaaaaaacgctgaatcattagaataaaaaataaaaaaaaaaaaaaagctgtaatgtaatgaatcattagaataataaaaataaatcgtgtaatgaatcatttgaataataaaaataaatcgggtaaagaggaggaaaagaagagaaacgcgaagacgagagcacgattgtcatgcgctcttctgaacacccgaatccgagtccgatgttgtgcgtatacttgtaccgcggaaatgaggtacaagagatagggagacgaagtcacaaggtgaatgacttacgataagaaaaaaaacagccatgacatacaaaatcgcagaataaacaacctcaatcctgacgatggtccagaagtgtaaagttaggggttgtcagacctttgagggctgtcgttcagttcgttaatgttggtcggaccttagccccagatcgattgtcgatagcaatcttgtatttgtaaggcttgttggaaggagcagacgaagaggaaatgtcaaggggtttatatagttgtcattccaagctaatatttatcgatagctttcatataaaagttgtatcacaacggtataactgcattatattttgtgaacgcatgcattcttgtattgatagaatgtacaatatgaaaaccgacggagcatcaactgtacaacgaccagtgcttctgattattatttttaagtctggctacacaagggttgaactgacctattggtttcactcacattcttgtcattgtgtgtatatatataatcattctatgaggaagtagggttagtctagagcagagccttggcaccagcagctccgatggcgacaataaggacccagaaccaaatctttcggaagattcggatcagcacgttggggtatacggagccggttcgggggaaaatggggccgaccagcagcaggttcttgaccatgcttcgcttggttttggtgtagggggcgtatcgcacgtcctgaagaggctccagaagcttgggctggttgaggtaggtttgtcggtgggtgaaggccaggaaggagtcctcgccatggtaagcaccgtaaccggacatgccgacaccaccaaacggagcctggacacatccaacgtggatcagagtgtcattgaagataaggccaccagagttgatctgggactggatgtagtcgccctcagaggccttgtcagtgaagacgtacatggcaagaggggtgtcgtggttctcgtgcacgtacttgataccctcctcgacggatcgggcagtgagaatgggcagaagagggccgaaaatctcgtcctccatcagggaatcattgtcggggacctttgcgacgacagtaggagcgatgaatcgagtcttctcgtcagtgttacctccagtaatgatctctcccttggacttgctcaacatggaggtaagtcggttccagtggttgggggtggcgatcttggcaaagtcggggttgtactggtcaatcttaccactgtagaactcgttaatccagtacttgcaggcgtcgataaactcctgctccacctcgggctcgacaatcacgtagtcgggagccacacaggtctggccagcgtttaccaccttaccccacagggctcgcttagcggcaagcttgatgttcttgcagttcttggtgacaaaaacgggcgacttacctccgagctcgaggatgacgggtgtcaggtacttgttggcggcagtggcaatgatcttaccgacagtgtggttaccagtgtacataatcttgtcgaacttctgctcgagggtcttggtgacgacggggacacctccctggatggcctggaagacgtcggggtcgagggccttggtgcacaagtcgccaacaattttggaagtgtggggggccatttcggagaacttgacagccacagtgttaccggcagccagagctccaatgagaggagacacggtcagcataaaggggtagttccagggcgagatgatgagcacgtttccaagaggtcgctttcggatcttgggggaggagatggagtactgcaggttggtcttgacgtcctcgtcggcggcccacttcttgaggttggcaaccacgttgttaaactcgccccacaggaaacccacctcgcacaggtcagtctcgtgcttgggtcggccgagatccttgtacacggcgtccttgatggcctcgacattgtctctgaggacgtagtgcaagtttcgaatctggtccagtcggtagttgagatcgagggtctttccggatcggaagccctttcgcagtcgctggatgtcgccaggaatctggtcgagaggagtggcaggcacaatggattcccaatcaaaggtagacatttttattggtggtgtgtttgaggaaggagggagagcgttcaagctttatatatcccatcgttacatgctggcaagtctgtcgtcatgcatatgttaatctggggttggaaggttatttgagagtgattgaatgggccaattttgacggggagttgaatgtatacaaattcggctgagaagattctactggtagcaattttcgtgtccaacaatattatctaacgccattagaactgtccatatttccccgccgccgtttatatcgtccaactctattaccaagtcccactttcacatgttcttgtcctgaaccttgctgtagaagtgtcgagaacatgacgcgatgttagatatattgggggacacttttgagatcaattcgttgaagaagtaataatatagacctatcagagctgatttcacttttgaatcacctcaataaattcttccagtcccaactgaagggctgatgtggtgtcggaatatgaaaagcactatgcaacagcatttttagacgagtcaacaaaggagtcgttagagacaactgttggcgctaagctgatggatacgacaaacaaggaatatgagactgagacatcaaccgcaacttaatgactacaggagaggtgtttttgtgttcatatcacatcgccgttcgtggaggggactatggtaaacatgtataagccctcattttacccacctcgtatacttgcttgcctcttcccgcgttcacgctctggcattgagtttagtgtgtcgatcccccaacgaactaatatggggaagtgaagggtggcaaacgtctcgcgtatgtcatgcagagaatttcggctttagtggtgagcaccgatttgaaggggccaacttcatcatgtcatccgatttattggggtggggggatgacagaagcgtctttcttatatcgcttgctgttgtattgggtgagtggataacaactctccaagtaggagcgtgtttccacagaaagtcgcttgagagcgtgtacatgaatgcaacccagatctatgttagaacagaagatatacaggtactgtaccgatatgtgtacatactgtacgatactgcagaagagatgtcgatgattgtaaaataattgctggactgtctatgttctgattccttgattatgactacatgtttgtgaccacgctcagatctacagcatgtacgtgtacgtaggcggactctgttatgatagctacatctatgttaatggtgcctgataaacttgttgacgctatttggaagccatatcattctctaatagcccatcatcagataaaaaatcttctggacatttcacttctcatggaacttctttttcacctatcacactcattaatacatctactactgtacagtacaaacccattgtagctcacatctatatacccatggtttcagcactcttgaatacacatccatcctcctatatcctctttcatactcatcttgatctcattatactatacaatacatacttgtggactggtgcttgcggtcggggcagcactcctcctcttcatcgtgaataaataagcccttgagctgtccttgctctccgtctacctcttcttggcctggtcgataatggacatcaacaaagctgggttctgcaacaggtcgttctgagcaggcgcagcaggagcgtttcggagattgggatcgttcagaagcgttttgagtgcgtccagatcggggggaggagctccagtaggcttgcgaggatgggcagcgggagcgataggagttccagattgggccatgtgatgtgcaggagcaccatgcatacccaatggggcgacggggactccgggcataccagctggagcgattggcaccccaggtactcccattggagctccaggcactctttgaatgccgacaggagctccgtatacccctccctgaaatcctgcataaggggggacgacaggagctggacccacaggagcattcactggtgcaacaagagtaggagcagcaggagtcactggggtggcagtaaccggaggtgtactctttcgggcgtccgaagcacgtctgctagcgtttccagcattgccagcattctgcttcactcgatctctcatagactgtcgtttcggagggtgcttctcgcttgaagccacatgggactccacactaactgctgctcctcgcttgggactcagctttccaacaatatacagagccaccagcagcggtctggaccgtttcagactgctcagctcgacactaggtttcacaagagagcccaaagtgtaaggaggagcatcatcgggagccagcgggatcaaatacgcgtctttgacaagcgtcgaccggttatgaatcactccatactttgatcgagagtggaaatactcatacaacttataatacgcctctctgtcggactctgatgaatctgaaggaagcaaacaaaaggctgccacgtctctagtcccggctccaagtaccttgctaagatagggatcggcctttgacttatccaagcgaccctcgatagtaagaggcttactggcgtagaaaacggagccccaggaaacattggggttgaaatggaccgaagaagagcccagagaaaaggcagcacaggatgtcttgtcgagtccagccataggtactgttcccgtccacacaaacggagcctcagagatagtagtccagtcatccgtctcagcctctcgagcctctcgagacacatctccaagaataccattcaccttatcttcgtgatcggaattgtgatcgtgatcatgttcatgatccgactctccctgggccagatcaatgtcccgtttccacttgggcactattggcgagttggaagactcttttggggagtttgaagtctttgagtccgcttcgccgttggcaccttcgatatctctgacggctcgttcaatctgatttctcgactcggcagcctctttcccgtctccatcccgttgtctttccatcttcagagcctgatccacattgtcaatgtactcttcgtactctccaacaatctcctcacccttatgagtgcgtctgagccggggagcttcgtccacaacaagcactgtgtctctgatagcttctgctcgtacctcttcggccagcttttgcaattcaggattcatcatctcctcagaagacattgccacaagagtttggggtgtcacctggcctgtcatgacccgaattcggagagtctcgttcttggagtcacgcaggttgaacgagagagtccggaacttgtctctgtagttggatccaatctcaggctccactgttccataagcgtcgtacagctcctgttcgatggtaagagctagcgtctcacaaaactgctcgggagacacgcctgctccgggagagtatttggaggttggaacggacacaaagatgcccttgagagccgaagcagcgcttttacgcaccttttcggtgatatcatcgatatgtcccacccgtttgtgtgttgatttcgagactctagccacaggttctttctcagctgtctcgttgttaggaacatatgtggaatcatatttctcatccttgtcgtttgagtccttctcctcctctcccttgcccttatcttcactctcttcttgggcttcggtggtttccttctcttgtgtcttcttctcagtgcactcgttgcaaacgtaatgatcaggaacctgctcaagatcattggtttgcaacacgcactgcgaatgctgccattccagacagtcctcgcactcaatcatgatcttgccgtcagaaggatcgtcctctgtagctccacagggacatctgaccactccctcctcgtcgttcttgctctttttgcgcgctttagatctggttgtcgtcttagctttggttggtgtctttagcttggtcgtcttggggttcttgtcgcttgtcttggggtccttcttgtcactctttaccttgccgggctcctccacagcctcctcatacttggaatgtctgcctcgggtagctcgagtggaccgccgtcttgcgggctccgctccatctacctccatattgattacgtacgagaaatgagtgggtacggtactgtgagtagtacttgtacgagtagtggtgtttctaggtggagtgtgtcctgctgcttactgattaggaggggcaagtagggtaacttaaagtcgtgtgcaaggggatacgaggcggtatataagttggacttctggtgacagtgagtgatataaatcacgtataatatagatgtcatgtacttgtacttgtgactgtgtatttatttattgaatataccggtgaggtttccaaaaaaattaaaaagtatcatcaaacaaaaaaaattgcaaataccatacccttctcaaatagtgtgcatactaccaaaaataacaggcggttaaaaacaacacattctacaagtacacgtacttgtgttagaataaaaaaacctgtaaaaatcccatgaacccgaatccgagtccaatgtgctggtttgacattgtgacaggtcctaaatagctgaaatgtatttccctggaatataaaaatatataaaaaaagggcataaatgggatgacaggctgatattaaccttgttcagatcattgcattgtcacgtgattgctcagactatcatgcattagttggaaagtctttctgagacctttggggctaatttgacgtgccaatacgacacaaggaaatagctgctacaggtgtatcgtatcgtaccacatgggtagcttcgcacgcatcaaaaaactcagatacagctccatgttcacaaattcggtctcaactgtcacgtgactacaagtcgtgcagatgtttatcaaacaaatatcatttattcagggctacagtatgtacatacaatacgatagtacatacgggtcgtatctagcgagactaatgatgtgttcggtaggtactttatcgtacttccatagttactgtagatccaatgaaacagcttcgttactgtaagtacgcgtattgtatcgtactaagtacttgtgctctcaccatcactcactctcctcctccacaacccacaaagtgctgccctggcaccactttgtatgtttgttgaatccatcgatgctgaggaaaacacatctgcactctgcacacatgtatttctgtgttttgggcatggtagttaagtcttggttctctgaggaggactctacatgtatatgtaggtctcaaacgagatcacgaacactgaacgggacaagatgtgcagaaaatgagtgctgcaatacgtggtcatgagactagccaatctgcgaggagtgtgtacagtatcttacattcaaagagacgtgtctgaaccacaacatttcagtccgaatatgggacaatagagacacccaatgtggtccggcttgtatcatcactctccagaagcgccgaagtcattaaccaagttgccgacatttcaggtattgtattttacgtactgtatattatacattctgggcttgtcatataacatttgcgcatacgatactgtaggtcaggaccggacacatacaatggatacaatggggcacacaatcctgccacacaggcacatcagaagttggggctgatgaacaagccaaaagcaaatgacgtaattcatcacccagttccacgttcatcccttccaagccccttacgccacaagttgctaatcatgcataattcgtaatctatattgttttttttttttgttggtcctagactccgagtatggatctaggatcaacgccctttcgcgccaactcccgttccagtccaactcctccacaagtccatgaaaaaaggtcgtattcacgtccatgacatcaatatcccttcgagtccatgatcaaccatactttttcgctttgctcaggaatcttacttctcgttcaacttctttccctcaaaaaccatgggcttggcttgctggggataaggcagaatcttgacggccgtcttggaaaagacatacgacattcctgaaaggaaagtagtggctcccacaaagtagccgtagtaggtcatgccaacatcaaatgcagccatgtcagcaaaggtgccaatgatcggcttgctcatcaccagaccaatgtacagcatctggaaggccgtgttgtacttggagatggtggtggggttcacctcggcactggggatggaaaagtcccagaaccgggtgaaggtcttgggaggaggcagcgaaatgtatctgtagtagaaggcgctgagtccgaggccaaagtctcggccgagaatcagggttgtcaggtagacgggcatctctcccgctgcagccagacacaccgtcagtgtgatcatgagaaacttgtctgccaggggatcaatgaccgatcccaccacactcttcatgtcgaatttccgggcaatgtagccgtccagcatgtctgtgacacacgagtacacaaacaaacccgtcgccagcacctgctcgtgttggatcacaaagtagccaatcagaggagcagacagcaaccgagtgaaggtcagaatgttgggcagggtgtacaaattctcgtggatttccgacgggagcaaagtggcaggtcgcttgagagggtccaggttgagtttcttaagcacgggactcttaatgtcgctcttgagcacctcggtctgtgtcggtttggacgagttccatcttgctacaggatgttgaatgcctgcccgcaagggaggccgcaacgtggcctggagaatccgggaccgcggaagcccaattatgtgaggtcgaagagtccggatcatctgttgagagatgtggctggggttctgtcgtctatgaggtttttgatttttcctctgactttctgtggtgacaaactcgctaaactttgtgtggtccgatgttggggacgaactttggttgggcggagggactcgaagtcggcgtttgcgtgcaacaaaagaagcggaaatacgaagtgggtcgttttaatagccagcctctagcgaatgtacgatcattatttgttactgttcttcgttgacccaattaggaagccccggttctgaatccttagttatgccgaggcataagactaatttaccgtgtcctaaagtagggcacatgcgaccgttcaaccaaatcttccaggaaaagcgaacctggctgcagaagggtaatttttgaaggtcaacggtgttgtacaatatatgaaacgatatgctgaggagacctttctattgccttctcagttccattaatagtcgcatgatatttacttaactgtttttaacgattcatgaccgcctgaagtaaaccgtacaagtaagtctcaatgtagcgcctgtggcgtacttgtcctcgcactatgagtacctaccggtgcgagtacgagttcaataatcgtctcgacagcgcccaagctgtacaagatcaaacagcaacccagaagagcaaggaagacatgacaaggtgatgcttgagccatgtacggggaagacaaagccgtaaagagtggaatacagatagaagtagtaaatgctgtctcttcagattatttgggaaagagataatattataactgaatttactcgaatttctgtgaacaattcattttaattacaccattattcccactttatagacatgcaaccttatttcaacaccaaacgcgtcttaattaatgcctagtaatacatcacctcacacgacgcactcatgacatgagccagaacgaaaatggggacaaggaaacaccatctgagacgacagagtatcatgtgaactcgaccaatctgtttgacaaggggaatactccattcagacggagtttggggacaaacagcattactgggacaaacagcagtccaacaagacagaacgcgaaaaatccaaacaattcgactaaattattgaaaattacgaaagtgacaaaaatcgatgcggagagtaaaggagaagacggtacaacctcacttagcgtgaatgtgggtgcccatgaagcagatcagactgcaggatcatcgttgaacgtggaggagatatctaaagagattccttccttctcagcctccctggccatgtttgagaaggagtggaactccattatcgacaagtactctaacgtagaggaccagggcgatgtggtggacctggcaagtggctccatcgttaagaacaatggacatttggagctgctggaagatgaggaggagacgatatgggattgcatgttcccgatacacaaagagggagaggggaaaggtgacgaggcagctgtttcaggaccaccaactccgtcgctattgcaacaaatgggagagtttcagagcgattctgaagacgaggtggaggagaaggaggagaacaccaccaagaagagacgaatcagtttgtgggatgtttagcggagacttctcaacctcttgaacaatacacggacatacaatgctcgtactatactcacgaaaatattacctacttttccacatagactatttcattctaatcatatttattgaaccgaatccactgggtgacaactgagaacaataacatctctcaacacccgctaaatataacatcggtaaccccggcttactgcaaaggccacttctcgcagttgtactcacaattgtacgcccagtatggttagcccggtgcatacgactattccaggtacatacgaggggagccgtttcagaacagaagtacagcatctatatttggaggggttgagtgggtggggcatctgttgccactagtacaggttcttgtaactaaagtggtggcattgagcttcctagcaatagcacccgtcatgtcgagtgccgcaacagtggcactgatataccgcgacatctgctatcatgctatccaccacacacgaacaaggacaagtacacagtagaattgtaaaaatccaggaactccgtcagccttgtgtttcattttgagaggaggtagttaattataggaatacgaatcgggagaaagagacttgtaacagtggttattaggcggaaaacgtatttggggggatgtctatacagtacatacgtaccaatgaagacacccagttcacttgaaacgcatgtagcacattcttcgacttcacgggtagcagtaacactcgtctacaaggcgtctttagaagccagctccaccacctctgagagtagctacgaagcagctagagtacatacgtacaagcgacttgtaggttacaacggtctgtcggaaaaaacaacatggattccactgtacgtagctgatactgtacttgtagtgtagcgctacaaagtggtcgggatttgaaatatgttgtttgttcacatcccatgctacgatacttgtactgcagatactgtagatcagtcaccctattcagccataccatacttgtatgtagaccagaatactaccccgtatatcgaacggaaacgacgacccccactctggcctctcacatcgcagatcatcccaatgtcaaagcaagtgtatccttgtatcgtacatgctacagtacctccgatcggttattattgccaaagcacgcaaaatacctacttgtaggtctggacatgccgatcgttccggtttgagattccgaaatcgttgctgctggctgcagagggcatatagatgaagagttcgtgcacacacccgcctgtaaagggtttcatttcgtgtttgggtgcattcactcgtgggaaaaggacgcaaagggcacctacttagccgtttctcccgctctgggcacttctcaaatagtgtcacacctgtccctttttggtaacagcgctgtacagtcagataatgacaaggttacgttgggccttgtttcatttttcagcgcttggacgtgtgactatcgtctgatagtgcgatattatttgtatcagctttcgcagccgccagaacagcaagaaagtggaaaaaaacagtcgttcatttttttgcctccaattttagaccctctaatcttcatccctaaatacctcatttaaatgtcacaagcgttcatttttcgatatgtccaccctctatgtcgataaccccttcgctcccaattaggttgcagcctatcccgatccggccaaataattatgcgggtgccctgaaaggggatgcgggtttctaagacccaaaaccaacaagggaaaggaagaatgtatactgtagtggagaaaatggccacttgacgtcgtcacaatgacacaccactagtgttcaaataaaatactaccctacacagccttcaaatagtgccgctacagcccctagtttcaggtggcggaagatatccgcacattcgctcgccaatcgcgcatttgcgcatgggtcattaatctcacatgaagggttcatcgctttttctcgtcacgtatgtactcctgattcatttccaccatgtgtgacaccatgctgtcaagtacaaaccctatttacaagatgtaacagatgtgcctggctatcaactctatttgtaacgcgtaacgcgaaacaattggattgttatgctgtctacctgcgtagggctggcaggggtccagacccgaccgtatggtgggcagccccaaaacgacgcacaaaactcagcaacacgaacgtaacgtcgttgtgtcctacactaaatagctttatgtttaccgactcttgagttgcgattgtgctagtttaacctaccgtgcaggtaagacctttgccactgagagatatatcaggtgagcggtgggcaggtgatttttgacttcataaatcttcgttaatcgaataaattcagaaaaaatcaggggaaatcaggaacccttagaaactacatcatcctgggagtctgtgacagtggtttgaatttgactgtttcatagccagcctccctctacagactggtcagcgatcatcgaacaaaggggaatttcgaattcagaaagataaataacagcgtaagcagttgcccgttgaacaggcaataaatagatcccggcgcgccagcgctaccaggccttcttgtagtaatcctcccacatcttcacgtggacttcaatcacgtttcgatccagatccgggtacatgttgtacagatggtctaccatctggtcgatggaccggcacagatggtgcgttctgacgtgcacctgggcgaccttgtcgtgttggtcagaccacttgactgccatgttttttcgagtaaaaagatgttcttgaaagtgtgtggtgattaccaagaggttgatgcaaaatgcaagtggcgagaaatgcggtggacggtgttgctggcacaaaggagtgggtaccaggtaacagagaggggcaggtgatggtggttgttgcgtgtgcgtggtggttggagggtgtgagagaactgggcgttacacaaatgggtcacagactgagtatatatatactgacgtttgtcatgtggggcttaacctcagggggagaagtttattcgggttctcaaaaaatattggcgtgcagaaggcgctttgtttgtgagtggaccggacctacagacacacaagcaggcacagatgtgggctgaaacgtgagatagaaagaaaaaagtgtgctctaacctgcaacgagaaaaaaatagccagtcgaaatatctgctcctgtttcagtttcagaggatggggttgcgtggttggctgtgggattggtgtgcagctgctggaccagtgtttctttccgatcactactacaaatacagtagctctgtctgccgtttcttgatactgtgctcagaccaccggagctgtctgttccgtttttcaattctgctcgtcctctcaattttttttctcttttctcttccgccacgcttcacttgttccatgcatgtgtgcctgtctgtcagtgttttggcttttaagctcgcctgcaaggttgactttggaatccgtctgcacctgggactctcagactttagggggtcgatttgtgtcagattgtggaggagctaaaccacaaagaccggcggtgaaataataaccggctgtaaaggccccaaaataataaagggatgttacgtgacgcgtgtcccgacgatgaagatgaaacctcctacaagtagtagtcatagtgataagggtcagatcaactacacaagtggactgtcactttatgcactactgtaggatacacaggaccagtcgaaagctcttgggatccattggccccattgtataccgcacgcgaattccagatgtgtgacattcagatgtcgtatcgtagatgttgtagctacagtactcgaactgtgcaattggacagtatggaacaattgttagaatatattaaataatgttgcgttttgtgtgtgtttgtagatgttttgtagttgggtgtggatcacatcacacccttccaatacttgactctcttgagcacgaaggaaaactcgtggccgggcagatggggcatcagagtcaccgcagaggtttcgcacgtctccccaatgttgagctccacgtagtttgccacaatctgatcttgttcgtatccccaggccatgttgcttgacgacttgtgtgtaccgacagtgtagttgacgacttgtctgtgaggcttgggtgggtgtggttgaagggttgtctttgatcgcccgacttgtgtctgatggtggatcagttacatcccgacctatataaatacacacataccgcttgtggctggccaatgctgatacagccctggtttgggttttaccacactcctaacaaccacccccccccagtttgaataatataatatcgctttttagcattttgaagccagtggaatcctgttcgaattctgagcgccccggaaatggaatagaccgggtaagtacgtcttccagggacttctcctcaaaagaagcgttttcaaacgcccggaaacggaaatctaactgaggatctcactacaagtagatgcgttttatccgctcgtagtccgcctaagggctccgttagcttgaaaatacatctccgtcgatcagaccaaaaaaaaacagggccacagtattttgactttgcacattcgtgtttctgagtgatagacagtcaaccaacttaggggttggctgttttacttctcaggggtaaggtgattgacattgtgactgattgattgtgattgtggttgtgattgtgaaataattgtacagcacgtacttgtgtcagccgctcccactcatatgtacaagtgtacccaggtatcgatatgtaagggaactccttccattattctcactaacaaataatggaaggaacatgcatggtaggagtcgaggttagcgtacgcacggaaaatactgtgccatctccgggtctccaaccaaaaccaccaccaaaacagggccctatcgttggatagtggtgtaatcctgagactacaatgtagggtgaagtttacccggtcgcaggaatgcggagtaaagtgattttactggccacacagaccagctagaaaaatatagaaaaaataaatgtgccgataatgatctcacaaactcattaaacccttttttatctcataaactgtagaatttctgattctgagggtctctccatcctctcgcactgtatgcatcttgacccaaggtgtgctgataatataaacacttattattcggctagttttggggccagtttaaacagggaaactctcaatatgttgaccatcctccaatagagacagcgctaaaatatatgatgtcccagatcattccaacccccttaaacagctacattttcaccctatacccagatacaaaacaggtcaaataaagttgctgcacgattgaaaaaaattactgtccgccaccagaatagagtttcgagataacctatataagcatgggcacacccacacccagttcttttctgtaagtgacgtattccataggatcatttctataggacatgtctctcatgacttcttaaaagaagccacttattcaaacttggttgatgagatagaacctgcaaaccccagagtgagaacacatttgtttgattgtttgtccttgtgactcagtcatcttattattcccggcgcgcaagcgttcaaggagcgatgatcttgtccctttgtttgagcctctctggaggagtgacttcgggtgggtttgtatggcagtctgacaagtttccagaggcttctcttggttattagatagatgaatcgtgactatttgtacgtgtatgcaacattggatcgtagagtgaatgaacagtgtgaacatgtaccataagatacttctactactgtactctcgtgcatgggagagtaggagctggagcgatagcaaagagatcaattggagattggagtcttctaagtgatgtatgtcctctctctggagccacatatactattcttgtactacagtacattccagcactcgtacaacagtgatctaccttgtagctctcgtatctccaaagtgtgttctaacatcagactgaagcaaactatgggttggagaatgaactggggatgtaagggcaaaaaaagggaaagcctcagcttgacgcttggtaaaagaattgcagcacccaggattctcgtatggtctcccactacaatactaactgggctctctggtgcttgactatggctgatcggacgggaagccgtattttcaccaggatatggccgcaactggttttgtaacgattcagaagctagtcataaggtgttatgattagtcatgtgccttggcacgtgactggacgatgatgacgtcctccggacgtcatgagtgtgtcattatggatgaatacttggtatcgcgtggctaggtcacgtggatagtgacgtgctttacagagttagggttgagatgcctgtatatatagccaccactcacaagtatgtaagttaagttatgtttatacgacttccggagctcgtactattggtgtactgttctgtagagtaggacgagcggttcccgctcgtacctagggatatcttgaggattgacccatcaccgatccgttacaggtttcaaggatggtcaaagtggattggacacgctgattaagtcacgtgagtccaaaaaaaagtccataaaaaaagtcccgatgaaaattccctacaattagggtgaaatttgaaatgttctacttcaatgccttttatgagttccggcgtggttgtgtatacatctcgacatcctaaatacagtaacatcatcatagagaaatactaaactgtgcggtaacagctcggatcgtggcttctaattaaccacttgtaaattttctacatcacacatctaccagtagtatacaatcaatttgcgctattgcaactaataaataatgttcgttgttcctactcgtacaagcacgactacttcttgtagcctctcttggcctcatcagacagccgcatactctccttgatgttgaaacctcccgtcagcagctgttgaatctgctccagatccatgccggaagtctcgggatacaggaagaagacaaacacttctccgagagcacagagaccggcgtagaaggaaaatgttccagtgggggtgatattttccaacatggtcaggaaagtggaggacacaatgagcgatcctgcccagttggtggcagtggccatgccagttccaacacctcggacggagatggggaacagctccgactgctgccatggcacattaccgataccagtggcgtagaaggcgacgtagacgagctgagcaacgaggaccacgtatgcccatccggaaatgtgttccttatcgagctcatggttggggttcttttccttctgcttgtcaaggaagtggaaagcaatggcgttgacaacgagtcccagagacatgccccagatggttcccaggagaattcggcgtcgtccaatacggtcaatgaccataaaggcgacaatggtgaagacaaagttcgttccagcaacgatgatggagacggctgtggcgttatcaaagcccaccacctcaaaaatggtagcagaaaagtacatgagcgagttgaaaccacaaaactgctggattccctgcagtccacaagcaattatgagggctcgcaagttgctgggtacgcaataaagttccttcatagtgtttcgagctcgcgccatagtggacaggccggactccttgtatgcgttgtggagcatgagttcgtggagctttcggtcgagaaggttgtcgtcatcggtggcatatgtcttggccagcaccttcttggcctcagcaatcttattctttcgaacaagatatcgaggagtctcgggcatgaacacaaagatgaccatttgcacaaaggcaggcaccatagacagaccaactagaattctccatccttggtgcacgtgggccatgccagcaccaattccgtaggccacaagctgtcctccggtgatagccaggacgttgagaacgacaagacgacctcggattcgagtgggggccagctcggaaatgtacagaggagcacatagagatgcaatacccacgccccatcccatgacgaatcggcctccgatcatggtccacacggcgtgagctccacactgaatggcagctccaaccagaaacagaatattggcaaaggtgataacccactttcggccaaagaagtcgcacatggctccggcaataactcctccaaggagagctcccagggacgtggaagcagtaatcagctccttatctccgttggaaagggcacgtccaagatcctccttgatgaccaccagagctccagaaacatagcccgtgtcgtatccaaacaggaatccggaaatggaggccagggcaaccagcacaaacacaaacggcgagattttctcggcttctaggttgccttccgaaatggaaccagtggtctcgtcctgagtactagtactggtcaggcctctcatgatatgggtcccttcatcggcactgcttccagacgacgactcagaggtcgtgatctggcggtttttgtccagcgacattagttcgatcgaagtcaatgttgttggttggtgtcaatgagacgtgtaaggtgtatactcgaagtacaatttacaagtatctgtgtacaaagctaactaagcaccgacgctaaccgaaaagtcaatgttgcactagagatttacttggtgtatgacgatgtaggtgggggtcacctgactcaaaatgaagctggtcacgtgatgaaccatgtggagttgtctttccccccctaatcgtgagtaatatccttgccaaagcgctctacgcaaaacaattctagtttgctatccacacggcattttggattttacagttaacccgctgtaaacgagaaaaaaaaattaattaaggtcaagatttcgacaccagaaaaggtactcaggggacgacgccaccctgggacatgtccaacagggtttgcttcaattcctgaaggaagcccagatgtgtttctacgatggacaaccgccagcacttcacgatgagcgagagtagagacagtagcaagcgcaaaaggcggccgaggccaccgagagaacagcgtagcagggcgcgtagtcaccacaggggacgcagaaccaaaccaatgacgaagaagaaccacaaggagacgttttcaaaggcaatgcaaatgaagagggcaatggaaggattgagattagagaactggagactggagtggcgttttcccgatgaacgaacaaacacgcgaagctatgtggaccaacatacaacacggactgaaccaggtttttttatgattttgttactggaaataggtacgtgccaagttggaccatgaaactaaacgtgtttaattagtaatattcgtgtaagcgtacattcatttcaaaggttattctttcacggcaaagttataattaaatgaatgtatatgcagaaaaaaaaaaaagtttttgtgacccccaaattatccgccctcctcaaaggaagagtgcacaaaccctactttatgggagtctcgatagcgggaggaatgatgttaagaggaatgggaacatcaattattttctggttttttttaacaattttatacgatttgttggagtttttttttgtctccttgtttagctcacgatttatcctccgtagccgttccgtcccgttccacccgccgcttattacttgggacgccgtagctcctccaatacagtacgatccgtacatacaggccgcagctgctggactgaatgctgctcgcgtgcattgtgatgacttgttttatgttgattggatgtcagagggagatccgcgttaacattgatccgtttgtccgagtaggctcacagtagtgacaactgtagagacgactgtctcggaactataatctgcttgaccatcttagaataaaccaccaccataccctgtcaaacaagtctcagggctgcattcctgtctcagccccgtcatgccaagaggcaacgcgagtggagtgagagtcacgctatctatgatgcagtatctgcctggaggtggatcgcgtttgcttgtatttgcacttggtaggttgtgcggtttgatggaagcagaccacgttgtcttacagtaaatggtttcagctctaaacacgtctgagtcgatcctcctaaaagtgcggtggctggccatccttgactctgaagatagatatacacaacctttcacagatgatgaattcctacgcaaatgcctctgttctgtcactacagtagcttcttggatccgtgaaaggaatttaccaatggatcatcttggactacggcatgtactcatacagtaactcacactggtacatcaagaaatcaagaacccatcaaattcttacaattgtagtacttgcaactcctgcaactatgtacccgtatctcgactaaaatgtcctatacactatatactgatattacaaatcatacaaccgcttggcagccccttcggcagtaatgtctcgctgcggcattcccagcatctcgaatccgacctggaacttcttgacggaggcagatcgcagaagaggagggtagaacaggagccgaagatgctcgtagggacagttctcaacgtccacaaatgattgatgaatacccattgagtaggggaaagaggtgttgaagagcttgtcgtacttttttgtgatcaccgagatggcgtcggcaagatgctggacttgttccttggtcagctttttgatggaagaaacccgttccttggacacaatcatggtctcaaaaggccagacggcccagtaaggaaccaccacgagaaacgaggcattctggtagacgattcgttcgtttttggacatttccaagttgacgtaatcgaccagaagatcacggttcttttcgtccttgtatttcttcaatgaatcaaactccatctggggctcttcaggaacaatactggtgttccagacctggccatgggcatgagggttggagcagcccatggtagctcccttgttttcaaaaatcagcgagtacttgattcctcgactctgagcctctgtgtacattttctgccaggtctcaatcaccttttcgatctgctcaacagtcattgtagcaagagtcacattgtgtttgggcgaaaagcaaataacctgacagtatccgaacacatcttcttttcgcagaaggtccaggtcgagagcagtagactctgtgtgctccttttgggcctcctcaacgaccttctccacttccgcagttttctcaaaaacagcactgaagtcgttctcaaacacgaaagtgtccttgtagtccgggttcatctccccgttgattcgagcatttcgaggacacagatagcacttgtcgtcgtactcgggcttcgtgtccttggtgggctcttcttgctgtccctgccaaggtcgcttagctcgatgaggtgacaccagcacccatgattgtcgcagcgggttgtatcgtctgtgaggaatgtcggatgccacaagagtcatatcgtgagttttgtagcggatcgtaaacacgtggatcaacacttgggggagagagatgcaaaagatgggctaaagcagatcgggaaaaagctggggtttatccggagcggaggtataatcggctttgagttctgtattaaacttcaataagatggggtgaaggtaggggactagagttgcaatattgagggtgacagggggtttttatgggtgtttttgtgagttgaggatgtttaaagtctatatatttgttgatttccaatttccaatttcttttttggactagttttgggctactctcggcctacttacggcgcgatggtgtttcaacatcatttttaatttaatagtccactgggggagcttcgcattacagtaaatattagtcatctacagtaccattagaaacggctgtttatagctaatatatcagtttctttcattgtgtgactattcttcatcttcttcaatacctgctcttttgtgtatcgtatagctacagtattttttgtactgtaagaggagtggctcaactgctcgtccaccctgattttctgctctgcttgacatccaaagagaatgttgaggcgaataacgcttaacgcttcttaacgcttctttgcgtttctaaaaaaacatgttactgtagtacagcatgcttcatatgatcacatgactagcaaataataaattcattatctttcagtgctgattaatctaaatatccccctttttactacggttcatctcgcgtaagcaatttacagtagattggtggtttattgttaggggactgtacaagtattccaagtaggagtacaagtacatacaaatacgagaacaatttctacagtacttgctggataaaagtgagaagtaagatggttttaatgtggcagtgttgtgcattttattacttggttgaagatgctaagtcattttacataccacaatagctccggacaagttggtcgtactacccctacaacacgacgcacaatcttcttacaggaccatgcataaaagttatccagttactcatcacacgatctctttaccttacaaacttgtgcaacatggccaaaagaactgctaaaccaacagcgaaatcagcaaaaatcacagcctttccttggcccaagtctctgctcgacaatgacccctccaagtcgtacaaggtccacactgagacgatactcaaggaccagatttacgtgatccatgggtttctacccgccaaagtctgcaatgatctggttcaaaccattgttaagacggacgccgacgacacacacacttttaagatggagacgacaccgctgacgaaacgaaaagattatgctgctcgggtcaacgatcgaggggcagtggaagatacagggatctgcaactacctctggcaccagctggagcccattatcgagtctgatccggagctgtcagagttcaaatcggcctttggactcaaccccaacattcgaatgtacagatacacccctgggcagttctttgatcagcattacgacgaggcggtaagatgcaaggtgggatcgactgtctgtactacacgatggacgttgctactgtacttgtcagaatgccagggaggtcagactatgttctacgaggatggagggaagtcgtacgaggtccagcccactaatggcagtgtactgctgcataagcatggagaggactgcctgttgcatgaaggacgagaggtgacggcgggtgagaagtggattctcagatcggacattgcttggaagaattagcgagcaatatcgaagcaatttgactgacgatggtgagccatggcaaaagagactctgacagatagtaatcaggataactgagactacagagacacagggcttggagtgttctggcggcagtggaagtgcctgtggtagagtcagaaaatctacgaccactccggcacttatatagcatcttgagcacaagctggggggtacagtccttagatgataagtgatacactccggatcacctcctcccctataggactgatagacgacgtattgtatggacgtgggaaaagttacggtcttcacttgttgaagtatgtagtgcacgacagcagtgaacacaggactgacaggactgcctcttggtttctttactaaagtggatttcatacttaaccttttgtcaagtataatagtcaacgttgttagcttcgtggacatgagccgaatgaataactactgcggtcagcagtttcggttcttcccctttgccattcttgtaagtatgtaccacatcttctcattatctcaaaacttccatgtcacagtacatactgtactctttaacaagtacagtacagaagctaaaatacccttttagattactcagagcaatgccataaatatccttccaatagcggctatggtccacgattactcgatttgaaaaaatgaatctgctaaacagctcagcacatccaaggtgtgctcttcatatttctctcacctggtcacatgatcgccccaccgccttactctcgtccatacagtctatcttgctcccaactctattgctccaaaacgggggtgcgcatgtcatcatgcatgaagagtacttcttcctgccgctgagataatggtgtcatataaccacctactcatttgccacacaccacacaaaacacagacccacctcacgcacaatgtcacacaaccagcaggccgcacagccatcgtcgtcacgcacacaggtgattgaacgggaggcgtctccaggtgttctgaccgtacgaggagccgccgaagacgaagactccaacgttcgatttacagaggaagtcgtggacaacgaacacatggacaagaagaagtcgaaaatctgttgcatctaccacccgccggccgagtttggcgagtcgtccgaggaagaatcgtgtggctctgacgattctggacccgaatccgatgagggagatattcctaatgcccgaaaacccaagaagaagaacaagggcaagtgcggaggacacagagacccttctcccaatgcgtacgagcgaaagccacgacccaagaagaactaatcgttacaacaatatgcatttttacaccaacaaacacgataaccgcgctacttttgtacagacatatgtacctacaacactgtaagataggaattgtttttttgatgatttaagaaagaaggaaccaagtaattgtggtagctctgtatcttttaagtagactgtacgttctactcatactgctctgtacatttcttgtactgtactgtagagatctcttgggtacagtacaagcttactaacacaagtcgggatgtgaaataaggtttttgatctctccatgcctttacctggaaatcaaactagaccaacaacatcatcgcagaatgtcgagactgaccaacacagaggtgagtacgattttagaggacgattaagggattgctcttgattgctcttgaaccaggagggctttgggctgatccaatcggctagaacttgtgacacaaacccatgaatgaaacgatcagaggccatcaatatctcactacccacagctaacacagttcatctcgtcgctcaaggacgctttcgacggcatttccaagaaggagaagaagcactccctttatttcacacaaaaaagactcagtcccgccaacgtggagcccgaagagccttcaaaggagtaccctctactgatccgagtggcttacaccactggaggaaagaagaccaagctgaccaccgaggtggacccttctaatctcgacgagttctggaaacagtacacggacgtaatgaaagccggcatggctctcaagaagaaggacaagaagcgaaagcgaaagtagtcgtgagacagaacgattgcggaagagacggaaaaatgaatgtatttaatggtatttttggatgacacacaacatgggatggtgagagatcgattggtgtgcctgtggtacaggtgtttctattgttgtaccaagtcttgcagaggatgcgtgtagtatgttgcctctttggtagatgtatgatgaacgtcaccccagagttacaatagttccagtcgtgagaggttccaaagggttatcttaagactgtatcgtaccgtagtgttatgttttcctagtacactcgggttactggttggaccttcgattagacacgagagaattgtatcgtagcacatttgacctcaggataagacacttgtatcactaaatggcgttctacgaaacttttcgatgaagttcatgtgctagaaaagtgtgtcgtgtttcttagaaacacctgtcctttcttcacagtgatagcatgtactgtaattcgcattgtacggtttgcggtttaatactggtacgctcgtactcatacatacatcgctactgaccagatcctacttggcgatcaggcgtaattgttgctgttggtacaagtattcgaggacgtagctcgtcggatgctccgaagatgacttttcctatgacatactgtttttgtaaccacctccactgtgtactctatcaagataaatctccactgtacgaatttaagggacaatcagctcgctataatttcctgtttttttctgcatatttttgttgaaagctctgagaaaatccagtcgtttatacttacagtactgagactaacaatgactgagcaacggaataacgcgttgtgctgtgaccgagagtctgatcttttgcctgcttccttattgtgatattcaagcccaccttatcagcagccactgtcatacggattacattcacgcctaatatttagacccctttgcacagattgaaccactgataaatactgtaacttctggcttctaacaagtcactcaagccactcaatcttcatgttccgacatttaccgggcattctaagtcttagtcatgattgtgtagtatgtattgcgcgttcggatgattctataaccagtttgaatatttttcccaatacacctgattatttccccatgacttctcccttatttgtaatttcaccgatttcattcaaatatttccagctttccgattaaatccacctgcttgtggtcaacccacacatggaagttctcccaaccactcccacacacgataagatgtatatgcccccagccatggtggacatgcacaggaagaatgcagtcaagttgaaccatgcccacccttgatacaggatattgtaagatattcagaggggagaaaattatatcgagatgttgagaaacacctcataaatccatcaaattatttatctcatctctaccacctcgcaggccaaccccacccttcttcttgtgcacctgccccatcggaatccgtcttaacttagcttgcttggcatgtacctgaagttaaaagtgttatcgtgagtggacaatttcatagaattcattctctctactacactgccagtaacagagtcaggagtacacagattcctagcgtgtgctattcgaccctaacagagcacatttcctcaacttcacgagccttgcatctcactagaccgctacgaccgcttttaaaacaccacaaaactaccaaatcaatatcacccccaccaggacagagatcctctctaccagtacaaacacttcccgtacgtactcgccgtccacaaccatacctaactcaaccagcccggcaacgctagagttgcaacccaccgaaaggcacccttctcccgagaaatcgtcccggttatactgcctcagcatggactccagaaaactggcgcttctgtgctcgttcctggtggcctcaggctgcggaaccatgtatgtgtactcggcctatgctcctcaattggccactcgattacacttcaacgcgtcagagtcgcagatcatcggtctttgcggcaccgtcggagtatcgcttctgggtatcgcagcaggaatcattattgacaaatacggaaccaccactccgattgtgttgggtggcgtgtttctgatgctcggatattctctcattactttgtgctacatcaagtccattgaaagtgtgcttctatgtgccctggcactcatggccgcaggtttcggctcaggaatgtcctttgtggccagtatcaaggtgtgtgcgttgaactatcccgaaaacagaggaaccgcaagttcgatcccgctagcggcttttggactctcagccttcttgttctccactatagcaggtatcttcttccctggtaacactcagggcttcttgatactactgacagtactcacctcgtcgctctcactggttctggtgccctttgtgcgagtcattccggctgtttcacacgcggaagatgaagctctgcttgacgacggatgctcatcttcctcctgtgaaagtgtagacatctatggagtctcattgttcaaaagcatcgacttctggaaacattttctcatcatcggatgtatcgctgggtgtggccagatgtacatctacggctgtggatacgtcattcgagcccttgtgggtcccgacgtcgaaacttcaggggtccagtcgttccatgtcgctatgatttctttgctaagtttctgtggacgccttctctcaggatctatttccgatgtgcttacccgctaccaatactctcgtctgtggatgatcttcatctctctggctcttggtctagtaggaagctttctggctactgttgtcactgaaatctcttttctgtggatggtgtcgttgtcctttggtctttcctacggcttctgttacggagtctaccctactatcattgccgagatgtttggaatgacgtacttttcgcaaaactggggttattccggttcttcggcggtgttttcggcgtacttttttaccaccacctttggaaaggtgtttgactcgcattccaagggcgacgtttgctatgagggcgtcaactgttataagtcggctttcaatatggccttctacgtctttgctgtgtttgtcgtcatgatcttgtacatgatccacaacaactaccagaagttcaaacagtgaagaggagctattataagaatagtatagatatatatagaatagatgtgatgacatatattataaggtgaagatgacactttcatcataggttttgttctagacggccatttttgtcagcaaagacatgagactagacatggccgtttctgggtcgcttggaaacgagtcgtaatcgtcgtttcttcttcgcccatcgtcatccatctccaacctcgcctggagacgcatgcgagcctctttacgaatggtacgcatgtccagattgctactgggccatctgatgacgacatcgaggatgtggctggtgagcgcctggacctgctgggccttgagaagctgggtttgtagcgtctccattttgtcttcaaatgcggaaagctgctcgcacgtgagatggccgttggattcgcgtgtcgtgtgtgtgagttcttgtcccaaggcgtcgactctgatccgggtcagtcgaattgtgtcaacagcgtgttctctcatgagcactagattgaccaccacttcgtggagtgacgtcctgttggaaggggtgtctgtttcagacggtatcgcaggaacattggacttcatcacggggatatcacagcaacttgtatggcgtttggaatgttggtgcaatcggaggactggtatcgaataattgtgtgccaatggtatcgaatagtatggatcaggtaattcagatgatgtgtgcatcaacaataaaaagatatgtgtcgctggtgtaaaggctcggtcagtggctacgttgatgctgtatcagtgtcagcatggacgttgagcgtggtatggatgttgtagtgtcaagcaagtgaaactgaagcagaactgcctgtctgggatatgaggcgtatcttcggtctgtgtaggactaggcatgaaggcaaagccaagtggatgtaagggcaaatgaaaggtgctttatttaaagtgtcttgtctaccgtagtatgtgacgtcctgactgtggagttgatagtggtacacgctacaccgaagatagaagtatgaaactggtcgatcactcagaagaattcacgtcttctctgtctggcttacgtcaatcagcttcagatgcaattttgtaatgacctatatatagggatgctgatgtgttggaatcgagttgtggatactcagtcatgattgtcctaaaacagttgtctacggcttttgagtcgcacagttgatggtgttctcatggtgactgtgaagccacactggttgtgtaactgtgtggctgtcttgttaggagttcgataccgttggtgtgagttgtactggctgtgagaactgatccagcacgtgtcactagcaactcacttccgcactgctgtcgtgtcgtatctattgagtaaagccaggaatggggctctcatcggggtggggaaagcccttgtcgtcttcggcagcgtcggaaaagatatcttcgtcttctgcactgctggttccacttccattcacgccaagagccgtggtggagccgccacttggcccttcttccttgatggcgttttcgatcgacaggagcgtgtgttcaaacgactcgattcgcgtcccgagctcgccttccatcactgccagcttcttctggagttcttccagctggctctgcagctcgataccaatctccataggggtcacaaattcggccttttcggcctctgtgggtagaagaggtgtcattggagccatgggtgccaccagtttgtcgtggctgtcgttggttgtcattttaatgtcgtttggtgcgtcgtaggaggttggtttcacactgctggatgacgtgcaggaggtgcaggtctgaaccttgtcgtgtagaagacctgtagtgatgttagaggtatcctatgtggagaaatacaagagttatgggaggattccgaggagtacaagttgttctaatttgtctctttttttagtcaattcatgtctttcagcttttaagtaggatggtggaatcctttctgaactgtgctgtatacagtgaggccatacaattgcctgaacgatatgcctgaaaagatacttgtatcgtattcgcacagtgctacaactacagacgcatgattacagagtatagcaccggtatatatacgaaactgtacttgtggacatatttactcttttaataatcctcagggtggatcttttgactcgtctctcttcttaccagtcctgctaccctcactctcacagttcgaagcatctacacacttcattatatactaattaccgccgctcaggaggttgttgtccttcgcaaacttcatcactcttcgtaggatcttacttcttagtctccagtttgatacccattcggctcatgacgtactcctgagcacccacaccaatggtcagaccaagaccctcctcgatccagtcaaccacccagtcccgagtatcgacacccttctcagcatgagggttctccttctcgtcgagccattgggcccactgggaggggaatgcctgagaattgatggtggttccgaaatcgtggtcagggtcagccactcgaacggcaaactggaacttgttttcgtccacaaacggctggatggacacaaagatggaggacactcggatagtgggctcctcttcggggattgaaacctcagggtcatcttcgggagacggctcgggcttggcgtcctttttggtgtactcttccagagtggccatggcgagcttttcagcctgctgggcggttcccacaaaggtgttgaggtcccgggtaacggaggcgtctgatcctcgtcggtgacgctccttacccttctgcaccaccagcttgagctctcctccgccctccacctgctgcatcaccttggaaaagacattgtagacaattgtatcgatggcggggtagccgacgaggtcgtggaacacatggatcttgagctgctcgtgtcgcgaaatgggaggagcaatggtgtccagaacggtcgagaataacgactgtttcttgagcatctcggtgagaccagccacagtgatggcaggcttgctttcgccccgctcggcggcctcaacctcctggttggtaagctcctgcagctccttgaccttggcttcggcctgcttgactgccgcagatgccgtgtcccaaatgccatccttgtttctattccaccaggacagagcagctccaatggcggctccggcatccacgggggcagcagaagcagcgtggtcgacgtcagagtcgtcagcagtctccttcttaacaggctcttcctccttgacgctcttgacggcatcctcaatgctcatgttgccactctggacctcgctcttcaccttctcgatgccagccttggtggcgggagtcgccttggggttcttggccagtgaatcgaggaacccaaggatatcatcgtcgtccttggcatcagtcttcttgtcagcagccttggaagagtctgtggaagtctccttcttgtcgctcttggaggtcttgctagtcttgtcgctcttggcctcggactctagagagtccagcatggacaggacgtcgtctgtcgtctgtttcttgtcggtcattgtgtcagatgtgcttgttgtgtagtggtgtgctgtgttaaacaccttgtcatgcgtgtcccccaatcctccaaaggttatcgccatgtccagggcaatgcatgggtgggagttatctgacgcgttttatagagattttgagtgagggaaaaactgactaaaataatagtttcgaatagttgagttgcttcgtgtatctttcatttgtttttcgacagttatatcacttttaatacccccatcatagcttgccctacaaatctgcacatgcttttacaggtgctgcttgtgatggcgaaacacgtgcgtatgtagcaagtgcaccactagtggtgaacggctagcattgatccgaatggactgaaagtagctgttcgatcctcagcattatatgaatgtcattttctgcacaccgagactactgtatgtacttgtacagctggtgcgttcgccacttggtaaactagcatggctaaaatggtacaatacgaaataaaatataaaatagggtgcacttgatacagtaacaggtaataaccgaggattgtagcaagtactcgtatttttgcatctacaagtcccgaatatatcgtcaatgtttatatatgactatggttcagaccatgtaagccaagtgggatgtgtaaggaaaaaaaagaaataaaccatatcgcgcccaagagagctacttgtacttgcaaacccctagccgtctctggggctacaaatgaactgagtatcatggtacaagtagactggtagaagcagacaggtatagctcctatgagctgggtaaagaacatgttgatctgagtacatactacagcagcaccatactctacccgtgtgtaacttgagttgccgtcagaggtatgaaggaatgaccatggaatccttcaaaaccacccttccagacctcttcctagattcggtcgactgacagactggtagagtcaaaatgtccttaaaacatggcagagatcatcggaatgaagacattaatcaagctatctgtgttggtgtctggacggaaatatattaatggaagttgctttctttttgaactcgtactgttcatagatatgtagctacgggtacagtacttgtactcgtagtgtacttgcacttatagtcgtaatttgattgagtaccatgaagctttcaagacagaagtataggtatgacctccactcctgagatgccaatatccataacaattcaaacagattaaaactcgttttcacctgttataatctaatgtttgttgtgtctgttgctgtctgtctcaactgtctgtgcaaaccaggctctttttgtttgttcctacacatacttgtacaccagactcactgatgaggattttcaaagtcttgaaatgaccattcggagcgtcatacagtctgaaacagctattatgatattccagtctccgaaatctgtttgtgcgtttattcatacagtgagagataaacaagatctcagacacatcacccacttacaagttctaagaatacaatcgctctctcataaccaataaattctctacaaacgtctccaaattttgtgcaataatacatttttttcctttatacctttgttacgtggtatgcgcttagtagaaggtagaaggtcgcttggaagcaaagatgtttcggctcttctggactcggtggggcagagggaacttgagatcgggggcaagcagctgcttgacgtactgtcgcttgacgtcctcctcggactcgagctcaacgaccttgaggacgtggatagatcggaatcgagatcggtgtcgggcagccatgtcctggtagagcatctcaacggcgttggttcgagaaacgtctcggtactccttgtacatgttgtgagtgccggatcgggaatcgtatcggatccagatgccgaagttcttgaccttagtgggggtcttctcggagatcttgttgatggcaacaatctcaccggtggacttcttgaccttcttgagctgggtcaggaagtaccagaatcgagacttggcgacaacctcgttgggggcgaaaattcgcattcggtagagcttctgctcgggagcagcctcggtaggcagctttcggccaataacctggtattcgttgagtcgacccactgagttagtattgtattgaggatacccttgtctggtcgtgcggagacaacattatccaacccattataatgacatcctccatgtctcgataatcacattggtcatgtcgcttccattattccaccctcattattcacagtgtcgtcgttccgtactcactttttttgtgatgctgtcgaaagtagaaagtaacagaccttgtacaacagcaggtatgagtgaaaaaaacccaaatcgggaatgcacgtgatgttgagggggtttcctaaatcagaaagcagtcacaaagtagggtaaccgttgggaggaagtagtaaggtttgggtgattggtggatgggcaaggaaataatgaaatcattggtttggtatatcgttgatgagggcggaacaatatctacatgttttcatttcagtttctttctcgttttattccaagtttagctatttgcttttataagtttctgttacgattacttatcgtaccttactgtactcccacctgtactcccacttggtgctgtctgtaaaccaatactgcaactactttgagtaaagtcacgtgaacagaaagagtgaatataactccagtcgcatgagccgtaattaacagtgaagaagcctttttgtgtttctgatcaataggtttgtttttgcgttgttcttaattcttaatactacttgtagttgtttgagacgtctcttcagacgacagacccacaagtattcgaaccggttcagtactcgtactggtagctaattagacgtacccttcacctcacgtgtcagacatatacaagttaattctgctgtctgaagttggtgtgatactttgataggaacttcagtaacgtctaaatcgatgtctataatacaaagtacctcaattcttgttgctcgtctcaacacgtttggtcccccttgataccacggcgcagtgcatggattacgtgcatacatcccaccaccgtgtgtgtggatgtcgaggtttatagcttttccagcaactaaaacccgaaatcaaaaagcgtttgtgggagctgtctggacaatggattgatttccttgctaatctcagttgcgacgcgccagtgggtgtggctgcttggccctcacctttgctgtgatcgggttgcgggattgcttggatatccaataatcaacctaaaggcggtattatctaattagttccagatgcaagcactagtgcgctgtatagcaagcgagcgatttggaaagagaacgcttctgctattactacgtattactctcaaagatagcacctcttcgtacatgaagatcagacaccgtacaatagctgaagttagctgcacaggtcatctgaatcaccaggtgagtttgatgacaataagacacatttggtaatgaacaaggatgtgatagtctttgctttgcatgttgtacttgtaccggtacaggtacttgtacgatactgtacctgtgctgaagattaacgattaaagtggagcacgttctgattagcgaggtgtagccgaggtgcaagctaaggtacaactgtgtacgtggtagtcgacatgcctgctacaattagcatgcaggtgatagtacacttgtgataagagcactacagacactcacgccattcccttggagacatgtctgagatttgtgtctcttgaactgttcggtttgttcgttccccaaccgttgttcccgtcatctttttgcattccagctaacgttacgctttatagcaacccaacggaacaactgtggcctatgagcatcgacgacgaccaaaagaaaatatacaaaacgggatgggagcgaaaagcaaagtggggcgttttggacaacggacgaaaaagaaaagtgggccactacgctgcatccacgtttctacattattttcagcgccgtagctacactgaacaagtacgagtacagggctagatcacgtgggaatacaggtgtacacaggttctgcactgtacttgtagaatacagatactgtagcctatgatggagattctctctcgttgcaaaggactttgcgataaagatagtttccgggtccgtccgtgctctacccatcggtgacgtcacccaagcttgtgcccatctgagtgtggtacagccctgtggtatgtacagctggcatggtgagaagccacggctcataggggcagtacaggggatgcaagacaactgtgggatacgaaatactacgttgcaggtagcaatccaggtgatgcaagacgaaacagcaatcaacagagctgtttcatatcaactacgtgcccctgtttgggaaggactcgattcttgcagctcatggttcgtgcttttaactgcatgtgctactgatacagccggttatgtatttgatacgcgcagatcttcaccaagtacattggacgcgtatcaatgcatcttggtatggttccacgaaaggataatattgtaaatagttggctcctaggggagtaacggtacgatactcgcaaggtggacgtgctccatcgctacgtcggctgatgtggactaagatgtatgcggtctagatcaattagctacttaccatattggtatagtctggatttacaccaacccctttcatccaatgtatgctcataacacagggataagctgtaagtaccggcatctactgtacttatacatcatttctctcccttcctccacctgaacctactgatctgtacgtgcgatgaacgatacgagcatgtgtttcttaacaccatctaaggaatgggtcacaggaatgcgctagtacgattctatattgcctcgactacgactaactgtatgatactgtaccttctggctactatgtggactactgtgctatagatggattactcgaaatcaggttttatctatcctcttcgttctaatctcttaaccccttttctacccgaaaatcttcattcgggaaaagttagctcgcttgaagaaaaacagagccaccagggctaggccgggggccactgtgtagtagctaatgtgcagagcattgtggttgaagtccgactcaagggcgagcagaatcgtgaatgccgttagaccccacaccaagtaaccgcccacacggtggaacttgtagatggcccggcccttgtgcacggatccgaacacctcaatgggccaccagaactgggccgcgccaacaagcatcactagcactagcgcaccataagtaatgatgccaaaggttccgtgccaagagtaaaagtgctccgcgtggttcttctccttgttgtagagaatcacgccggcccccacgcagtaggcgagcactgacagggagttgagaatgccgtggagctcgccgcccacctgcttctgggccgccgatcgaggctcgggctgagtgatcagaataccctggccaagcaggaagaatcccagtgagttgaagatgggatggtacgaaaacagaatgatgggcgtggtcagcactccatatagcaccgatccaatcaccaaaagcagcccaatctgcacgggaatggctgtaccagtgtacagattgctgagcgtctggcgcttgagctcggctcggctctctgtgcttactccctcatttcccaataaattctgtcggtcactcattttcgagtttcaagtttcgagattggtgatgcgtatgtggggttctgcaaataaaatgaatctgattgataagcgacacccaaaccgccaactgtggcgtgcttcaagcgcaactcatgaaccttagtattgagtaatacctagtcctaaccctcacaagccgcaccagataataaaatgcatgtgtgtatacaacccgatagctgaactctaatacgcgtaactccgccacaatagatctacaagtagaggacaaactacgccgaaaacaccgcaaaaataccccatcaacacaggagatatattatattctatgggaaaccccataacatgagcggatatttatatccaccaggtaatctcacagatacacacactcggcaaaatgaatgcactccgatcagtgataacagtccatgtctcatctccctcattacatcacgttgcattagcactgtaaatctttcgacgggtcactcgaggtatgcaactcgcaatgaccttaggtgcacatcacctgggcaacgtacattggtaaacaaccatatctgaagacagaaaaattatcctccacctaaggggtggaggaacatttaatgagttgtacagtatcgtacagtaggtaccataacacagaaccactactgtacgcgtaacactctacaaatcacactcattaatgaacgtatctaataacctatgacccttaaattataacgaaaactgtcttgttagcaaaccgtctagatgaccctccttaagcagaagcagtaacctcgtgaacggcggtgggagcagcgagggagttgtcaacagcggaggtggtgtgaggctggctcacgggagcaacaccagagttagagtcggccttctcctcgggcttcttggcattcagaatggactgggcgtactggaggccctcctgtgaaagatctcggacagtggcgacggtggcgtatactggaccagagacagtcttcttatcgtcgatttccgatcgcttgccgtcgtaaaccttctggatgtgttctcgggtgtgctggttgatttcctgaatctgggaagtctgctgctcaatcagaggtcgggctcggtcaaaagcaaccacggtgaggcgccatgctcgggccagctcgttctcggcatcagtcacaatctcctggcccttgggcaggtaggcgttgatcagggcttcgagacggtcgttgagagggtggaagatggggtcgagtcgggcgtggacaatgggctttccatgggcatcgtagtaggtgacaacctgggactggactctggaggcaacgtctcggatgggctgcacaaccactcgggagacagtgttcttggtctcgtcggcgtacttgtcgacagtacctcgcacgttctccaagggctgggtcacgattcggctgtagacctcgtcgggcttggtgttcttgagagagggcacggccttgtcgagtcggttgagggcctcgtcggcagcgttgtcaatctgagagatgtagggggcggctcgcttgacgacgggctcggcgacgggggcacctcggttctggatggcctggatgagaggaacggcgttggatgcaaaaatcttgacaacggggaaagaggcagcgaagccagtcacggcagcaacagctggatactcgctcaggtgctggatgaacttggactggggcagaacgttgccctcaatgggaccgttggaagtgttgtcggcgacagaaggcatttttgtgtgtgtatgctgtgaggatgtctcttgtgggttcgaaaaagctgggttagtgaagtcttttataggcatcagcgcccaaatttatccgtgcttgtctcactcccgcattgggtttcattacctgcgcttatccattttgctgtcaaagcaaagtttccaggtgtagagttcgagcttgaaactcaatccaaaacagtggtttttcggctcctgtagcgggaaggtccggctggagccacccaaaagcagaaaaacgaaaaacctaggctcagtgtgtggtgtggaaagaaatggcgcactagtgggcagcacagatagccatcgagaacagcaggatatccccctgtgtgtcgcggacccgtcccagctgtcattgcaacgcatctcgagctcaccagagacctccgaccctcggctctcgggatctgcaccgataatgaggtgaggtcattctcagtgcgccaagataattgttccggtcaatctaagggaacgaaatgcatgcaatgcaactttgaaaacgggatgtgcatgaacctgtgtgtgtgacgccacgtgaaagttggagcgtgcgataagataacccagagtggagtttgcgttgctaagagcaaggccggcgacggaagggaggcgacaacaatggctgatcgcggcaggacgacaacggctggtgaccagaagggggaccattttttgtatcagtcaaaccacccgcaggttcgggtagtgtatgaacttaaacgaaaaaataaaacccctgccaacagagttgtcgtcactcacgactaagacaaccaccctgcggaaaccaacaaggggttataggcccatagttctgtttgtgtttgtcgtgtgtttgtgtcgggaaggtacgagtactcaccaagtgtttagagctaagcactgcactctagatatcgcaagaaagggatgttttggaggagaagaagagttgtgtggtgccaggtgactccttaaatattggagggcgtggttttgtggtcttatcacacagtgtgtgttttcagtctttaggtgttctgtctatctaatcaagttaaggttttgggtttgcgtagtgtgcatttataaatatactatttggtgacactcgctgtatagctgtaagctgtggtgacgatgaggcaaagtgtgccaattcagcgtagtccaggaagctcaaaagacgggaaattgggccaggatcagctatccatctacctccatgcactgatccgtgcctatcgtggagacacacagaacatgataacttagcgtctagtctggcccatagtgctagtgctgtcatgaacttatttttgcaatgcacatgctggccattttattttcgcttacgtgcctggtacgagacaatagctgatgcgtatgttcagctctcggaaatctacatctgaattctttcaggtcctcatccaacaacaacacgaacaaaagccattggtatgaggggtagtgtcgatcgttgtggatatacgacactcaacttagtctatttgcgttaaatcggagactcggcaataataatggtgatacaaaactctgatgtggaacgcgtctgagggcttcaatacgagttgcatcatcgccagaagagtgacaataacgaacctggagtgcagacagagcagcagacaggctcatcgggcctcagttacatgccgtgtgtatatactaccaacatggtacctctccctccaagcgaaagacgactacatcttcaaggaagagcagctttacagtagaaatttggttatcagtagacgttcaaaatgagctacgaaatatccgctaaatctgaggcccattattagcccagatgttgtttgcaagtccatatccaatgtctctcggattcccggaataggccccttggaagtctttttttttctccttttttcagtctctgaaacacgatcgacccgctctggagctcggtaaagccgaaagtcgatgtctaccctacaagtaggttacacccgattccgactctgagacagcttgcttgtgtcgcaggaaggagattagcccatggaaacctggagttgcacaccatctggacttctggctttttggtgtatgcacagccataccccgcactcaactctaacctaaggctggttgaaaccctactgtaggcagtcgagagacaaaaaaattgtattctgtcaagacaaaagggcgaaacaagagagcgcgatgtcgagggcaattggaatgagctaagagagctggctacaagaagaaatataacaccattgcttaaaaaggactatgggggggtgtccccaagcggttgcagccttcatttattattccgtaaccggtatctccgccctgtctcgtgtatatctgttccttcttgccggctctctgcacatgtttcccctcgtcgcttgtttgtcacgagaggtctcgaacataattacaacagaacagacgctttgagcatgtgaagatgaagaaaagattatagagaggcttgtgcaaattgttctaaagaggctatgggttctttggcggccgccctccaagctacatctacaaaatacataccgtataatgatcatcgtaaaagtggctcatttgtatctttaggatcgacggaaaggggaacaatctgaaaagcacttcttaccgtgacccgagagttacttgtaactgtgccgtgtgcaatgctcaacaacggtaccgtctctgcttgtgtaatacctcacattctcgctactccatcccactcacacgactcactccagttatcacattcccactaaccattccctttcacaagcatcctgtcattgtgtcacattttgtgtggcacggtcattgtccatagttgacaaatcacctcctatgtgtgtcacactctcgcccttgtttctcatcccttgtccgtcagttttcgtatttcccctttttctgttattctgcagaacaaagaagcaagagtcgtcgtattccgcctgaaccttgtcggagcgataactagacacacccacaaaatagacttggtaggagaacgaaagtgtagtggatatcggcaaaaccacctgtaacgtgcttgtacagggtccgggaaatgtgagagctcatatctgatcctttcagacagtctcaaaaggaacctcggctgccggctcacttacacccccccactgtgcctacatccggtcctggtacagtcgttttcgtgacatgccacaaacggcacacatcatatttttatgtactttaccagctttggctctttttcccttcttcaagagctgcacctccgactacaaaactgcacgcggctctttcataccaaccctgcattgtcctcgcatttttttatttaatttgattgttgtgttcgtcggacgaaggttgctatcagaattccgggcatgtacggctttcctttttttaccaagcctagaccaactgttgcctgatgcggatgaagagggtgcataggccagcgataggctaccgacagctactaactgtgttgatcatgagtggggaaaaagtggagaaaaagaagcgcacagaatcagcactcttggagtttgttggaagtgctcgcatgtgatggggggcatgtaaaaaaaaaatcaatcacgtgacccatggaactgaatgagtgatggtaatacttgtagacgttgaaccaagtatctgccaatatgccgtgtagaagttttcaccgcacagaatataaacgagacagcacttgcgctacattcgcactacttgcgcaccatcagcgacgctagtggcttccaatatccgataacgtgcgtgtttcagctgtcaatctgcatcatggtagataagacgaggagatccatgtcgaatctgtagcgatgaatgcatgctgtactattattcgattattttttcatgtggagaaactctcgtttcgtactgtatcacctgaatgccgatccccacaacctctaaacacaagtcttatagctaataagtaatccgatatgtctatgtgccagtagcttacactctcgggcgggtctcgggcaaattgcggacagccctcattttttacctctttttctcattatggatgacaatgcattttataagctgtttcagattacatcccagggtcttgctgaattaccactcgagctcctcagcccatttgacaccccgttggtttcttctggtgcgccgtttgcgaccgtcgaaaaaccggtctctgatttccttcccctccagccgggcccgtagatcgttggcgctataaaatccaattggttccgaacccgttagtgctgaatgcagcgacgaaattagtttgctggatgatggcgtgtttccggacactctcagcgatggcttgaggttgatttcgcgctttatggggctacagattcgcccaggcgacggtggctcgttatacaactcggcctccgcaagtcttctgcttcttcgaagcggctgtgtgacattggccgcgaatccgagttgggaagactgagtacgaggtggtgttgacggaggagacactgacggaggttgccgttgaacgggttcgatgatttgaactgagctgtcgttgtggactatttctgagaggaattgaactgaactgtcgtccccatatgagtccttcccagagtcatcttctcgtgcttctgcatcctcttcagagtcgtcctcgaacaccttgagctttggtaggtgactgaattggagattggaccggaaggcagagagtcctggcttggtcggttctgtcccgacaggaacaatgggaggcccgagcctcgaactgagcactgggatcttggtaggtcgatttcttcgaggtgtgcctccgtttgtgtctctcttcagctccaggggtgaatggacttcaaggggtgttatggagccaggtttgcgagtccactccgttctgggtatgcttcttggggtcctgcttcgcatttctgagtgtgtttgtggtcgtggtgtcccctctgggtgctcgattcttgtgggcgaaaaatgaatgtagtctccgaatgaaatttcgtcatcctcatcggtgctgatctccaggctgtcgagcgtcgggatgagctcgtcgagctccttctgtgtaatttctgtctccgagtactctctgtctgctagaacgctttcgacgacccttaaccattcaaactcttgcatgtggtcgtccagaggtagttggtacggcgagctctgggccggggttgcggtcgagatggaagctgagatggacatgggtcttttttctggtggagaagaaggaaattcgtccgccaacttatttcaaccgaaaaaatgcgactgctctcagtttcgaactgtttgttgattgccccaaacaaccttgcataaaaagaaactcaaaccggcgacccaatgtttgataaaagcatatcctgcttgtatgctgtgtagtcacgggagataggggtttgggaactatgtagcggcaaggagcggcttgtacatacacacacacaggcatgtgaggggagatcagctgagaaggccacgtcacagtccctcgtctcttgtctgactaatgcctattatccggcccctaattgcactgtatactgtgctcagtaattagcattgtcgatctcctgtcaggggtgtgtcgttctgtatggatgtgtgtggggtgagaggctgttacccgggagtgaagtgcgaagatatatgcttcttaattaacggatacaacatcagatggagagtgtatgtgataattatatacagcgcaagacgaacgggaatgacaagtcagcagcgagagctccaccatcaaaacaaacacagaagcaccacattccagcaccacattccgtagacattctagggatcctaccttggactggcgtgacaaaaaacacgggactgaaatatacacaacaggaagaaaaataaaggagatgtgctaaaccatcctaaacaaacagactgacaaaaggatatgctgaacaaacacctgttagtccgcaaatttggcactttgaaactttttatctattttgcagtattattccagcgtcgctaagggattggtctgcaggtttcgtacgacaagtgtaagacaaaaaagctactccgcaacggagaattgaactccggtcccccgcgtgctgaacaatgttctgacaggcggaaattctagccactaaactattgcggattatgggtttttttgagcgttgtagtataacatcagaaaccagatgactaatagccaaatttcaactacccatttaagatcttgaacactcaagaacaaaacaaaatcaaagtcttcgacagataccacgttctgcaaaagtctgcacatggtcgtccgtcgagacgattgcaagttagtgaggacctaaaactccatatgagatggttctgcgacatcccaggtgacagcacatggtccgtcgcacttgaagtcagcgtggacacggataagccagtgaatcgataagtccaagagataacgccaagtctagcaatcacttccagctgatccatcaccactcaccaactacaccgctccgcacttgctcttctgaacaaccgattccgaatctgatttgcggtacaacattgtctttgggcctcgagtagctgaaagtattcccctagaataaaaaagaataaaaaagaataatacaagcgacgaaatgatgcggtttgcaggttagtagagtaataagggaaaagaaacaaccaaactgcaacccccagaatcgaaacaatcaggacaccgcttccaagttcagttatcaccaaggtgtaggccattggattgtgtgacaatggccacggggaccgctataaaacgaccagaggcttcacagatgttgctatttcttgacgataacagccatagacgtatggtgagacggttggttctgtattatatagctagcgtgagatcagtctcaaggagtagtgggtaataaccgaaagtgagccaacgcaaagcgctgtagtatcgatgtcgggtatacacatgacacgctaatagactagttgtagctacttgtacttgtacttaggttgaagacaccaggcaggtcatagaatatagcttcctgcgagaaacccggttgagacaagtctggcataggtaggtgcggcttatctgggttggttaagaatagcgatgtctgtcatgatgtgatcatagttcatcagacggttattttcatgttcaaataccagccgccttgaatctattcgttcaaagctaccccacacaagtctcaccattggctaagacagggaaggtgtggatttctagagacctacattatctgagacattgtaatagaagtgtcagcagatatactacctgaggagtctggtgattgccaaaccgcttagtgcctacttatgggtagaggtacgtacttgtacattggtttcctcaccagacctcatacttttattggaccgactcaacagtgtacatactgtacatactgtactgtactatgtactgaatcaactcagttgtctaacacccaattgccaccaactacagcagatatacgatatacctgatgttagatcagacaatgggattgaacagcattcgtgaagcactacttcaactccaggagcactaataaccctcagaaccatgtctctggcttcaattgagacatactcaatgcgagaatagtgatagaaatagcagaaaaataaccactgctatgtgagatatactagcagtgtacgtaggccacgctacacacagcagttcgaacaagcactgtaatatacgagtatatactgtactgcacaactcattgttccaatcaatcaaaacttttgttattagtaaatgtacatgtgcttagatgaggagggcggcggcaacaacaccaccgatggcaagagcgccgttgacgtaggccagagagccggagttcttctcctcggtagcggaggcagaagcagcggcagaagaagcagcagaagaggcagcagcggaggtggcagaagcagagccggaggcagcagaggacttggagtcagtcttggatgcggaggcggaaccggagccagaagaaccgtgggcgtggccagaggagttaccggagccctgggtgttctcggcgagagagcctgcgttggcgttggaaatagcctcagcggaaacaccggtagagttcttgcagacggcgttgaaagcgtcaacagagttatcaacctcgaaatcaatgcaattgtacaggttaccgtcaacagcctgcatgatgacctgaatggttcccttctggccgtccttgagatcgccaagaggcagaccaggcatgcagaagtttccagcaccaagctcgttaatggggccgtaaagcaccttactgaagtccttctggccatcagatccagacttggtaccacagtcgtcaccaagacagagtcggtactcagtgatggcggaggtgtgagaggtcttgagtaggacatctacggactttccgttgaccttgaatcgctcaccgatcttgttcagaccaccgcaggggccctgggtctgagtggggtgagagtcacctctccatccggggtagtagacggtgaagtgggcgttagctgtggccaggagagtggcaagggcgagggctgagagctgcattgtgttgggtgagtgatggagcaaagagtgtctggctattttcgatacgaacacacgtctatatatagtaaaggagttacatcatgtcacggaggtgacggggtaggcttccgagcgtatatgctctgcgacgcataaggttttgtcaacaagctaatgtaatataaggttgctagccgtgagatgtgataaacaatagcgtgtggtttaaccggtgtatctgaacctagtcttgtgggtggtcagtatgggggggggtcgatagaaatcaattggccacgtgaccaaaagtgcagcatttaagcgacactaaataggcgtcttttcgtccgttctaagccgctcctttaccctcagcttctaacagctccaccaacgagcaaatttatgcagaggtgcgcattttgaaaaaagcctatttgaacatcacccaatgaagctcttgaggatgtggagatgaacagcttgaaataagcaattggctgttgcacgctgggggactgtgtggaggcgaccgcgatctgcattcgtattgaaaaaaatggggtgacttacaggtttcgcacgtttgttggtgtgtcaaagttacttgtttgtacctacaggggtcataatcatcaattcattataagttaggtgcaacgtcaagtgaaccagaagcgagcaaatatatcggtataatacactccgttatcgctcgtgcatggattattcatcttgactcacaaacgagcaagttctcgcttatgcgcaggtgtgcaataatatccgcttaatttgctcagtgcaagagtcgtgacagggctctgaatttgctcgtatctgctcactctctagcttgcgtaacgggcaaacagcagctctccgaggaagatgccgccgagaaccgacacaaagtagcccacgttgtaggtcatggtgataagcatgagcaagtaacccacgccggagagcaccgtctgaatggctgctcgaggaacgtccacggaaagtctccagggacgaggaccttgtcgagtagtcattgtgggcgcaggagagggctggtcgggacgctcgagcttctgaagtcgttcctgctcctcctcctcatcgatctcatcctcgatatctcgcagactcttgtagggctggtctcggccgatgtcgttcagagccaccacctgcttgttgagcttgccacacttgatgagcttctcgtccagcttgaacttcaccacaaacagacctcgatagatcatggcaaaaaacacaatgaaaatacacgttcccgcgtactggcctcggttggagggagtccattgatctgaaaacagagcgtccaccatgttggagtggaaagtcatggccatgctgtgggacattcctccggacgacgagccgcccatgtccatgccgcccatatccatgcttccgtggtcgtggctcatttttgtgtgtgagaaatggtgttggagttgaataaaaaagagatggaaatactggaattatgagctgctgatgtctcttttttgagtttgatatttgctcgtttcagctggaaaatctgagtctatgtgcgaatagatttatactattactagctagcggaacactatgcatctttgagcaaactgtaaagagtgtgtggtatcggagtccttacgaccagctccaggaggttcctattctcagcaaactccctcgaagtcactcacaacatggtctacgacattctggccaccgccaaaaaccagggacagggctcatacaactcggacggatctccaagaccagggtttctgggaagagtttactggatggtcattggtgccattttggcagtaattaccattttccgcgtgctttcgttactgcgacaaaagtactacttgaaacgacaaaagccacccagatcagactctgttccagccaagatcattggagctatcgtatctacagctcgtgaggcctctctattacagatcccagggtttgatattccttgggtcaattacacggtggagttcccgccagtaggagacattctcatcattctcttttacgtgatgattgtaatgctgctgctcttctccaaaatcgaccctttcaaccctatgaactacgaaactgtggcctaccgatgcggctgggtgtctatttcccagatctcacttatcgtcattctggcagccagaagaaacctcgtgtccattctcacgggcatttctgctcagaggcttaacctgtaccatcgatggacggcccgagtgttgttcctgtgcgtcattctgcacctggcccactttatcaagacctggggagtcactcaccagattcagaaccaggtgtcgacaaatacgtttgccctgaaaggctttggagcgtttggaattctctgctggatcttcatttcctcttttgcgcccttccgaaacatgagctacgagttctttgtgttccaacacattgttactatgattggattcatggtagcagtcgttatccacgcgcccaattacgcataccatgtcgtaatccctcctctggctctttttggacttgacagagtgctcagactggtctggaacctgttcatcaataaggcagggctcaaacctcatcagacagccctgagagtcgagcctggagctgtggtggccacaattcccacaggactctcatggtaccctggacagcacatgtatctccgtttccctaacgtatctcctttagaacagcatcctttcacaatttccacactgcccggagacgatatgcagtttgtgattcgttcaaaggcgggattcactaagcggctgctcaaaaaggcctctcagctcccagaacacgagaaaatgacccttccagtctacctggacggtccctacggcgaaactcgtgatttcaagcagtttgacacctctgtttttgtctgtgccggtatcggagcttctttctgcctccctatcgccgtggacattattagaaaccagcacaagaccattgctcgacgtctcaagttcatctggatcacaaagcggttccaggacatggaactgtatgccgcccagctgactgagctgcttgaatgcgcacgaacgttctacgatacagcctctggaatcgatgttgttgtcgagatcttcgcgacttgtgaagatgactgctgtggggctgtcactaactgctctagttgttgttgtgacgaggtggctgtttctcggggcgaatgttgctgtgcagctggtatcgagccccagccgaaaaacgaacttacacaagcccagactgcacttgctcaatcatcaacgctttctccggtatactacgacttcgttgaggccgggtacctgcgtctcaagcagggacgaccccagccttatcagtataaccgacgaaagaagcttggatctgacaagtccttctaccggctcatttcgccggtcatttctatggctcagggtgagtctggagtgtgcatatgtggccctagacggtttacgagaattgtttccaacactgttgttgacatcaccgacgacagggcagttctgagaggtacaggtaaccaggccgtgtacacacacgtggagcattttgggttgtaggaagagggaaaggatgatgatgacatatatatatatatatataatttaacactgcatttgtatggaaagtagctatacttagcttacaaagagacatattcgctcaagcgcctacatcctgtggttcctgtaactgcgctacagtagaacaacaaattcgacaagacctgcattcataaaaagtcataagctgactacaagtagatacttgtacatgattagggattataccaaggaactcttactcactgtttgtatgtaagttcaaatcagtacaagtactcatattcttcatagtaacaatctctaagcagtttattacacactatcaaggtacagtatgtacagtaggtatggcggcatacgtcttcgttttattatttttgcacacgaacctctgaagcgcactgtacattgtacatactgttcagggtaagtcccttcccattccaatcaatgtaacatcccctaatgtaaaacttgtagactgcgccaaaaccactggttctcattccttctctcagtctagtgaggtgtcgtatcacaccaatctgcagttttaattagcaccattttattcgctattcaaccgtctatctacaccagtccacctcactccattcacaagttacccgcatcactgtagtgatccagcacaattctatatataaaggcagggctgaactcgccaatgtttgtgttgtagatctggatgtcctccgggggcacgtaatcggcaagagggttgaacacttgaaagccctccacaatctccgagtcggagtagtcggccacctgtgccgaagagccaatctcaatcatgctgggcacatcgaaggggtacacgggggacagcttgtagatggctgtaagtaccaccacgggggtggaatgctgtgttgctgtggcgcaaacgagagcagatccagctgatgaaagacatcctccattggccagcacggtagaagtgcccatgatgactcgtccgaccttagacatgacggcgtagacggcagcatcggggatgatgatggcctcgactccggcctttgtcagtttctccaccatgttgtgtgctgcatcaatctggttggggaagccctcggtgaccagaacggtgaagtttcgcttacgtgcggccttgagcagaaacagcagcacggtttcggatgcaggggtcggggtcagaatgatctggttgtcgtggatctcgtcgacagacattttggcaatgttctcctcgatgttggcgacctcgtcaatcagatcctgaataccctcgatgatgtagggccggatatctcggttcgcctgtcgcaaagcagccttgtccagcacctcctccttcttgtcgttcttctccaaaagacccagcatgctgccgctaagcccgccgttttcggccttgtggccgtgctgctcctcccgaatcagtgtcagcactcgcgatacgatatttcgacacgcaatctccttgggggcggtctgcaccagacgcactcccagggcacgaatgtccttgactagagagtcaatgtgattccatcttgcggcagaaacaaaccgcagaagcagttgtgccgtggccagagcaactgcgtgtgatcccgacaactgtcgacgtttcagttggctatgttagtttcggcttggtgaggatgtcgtgatccatgtcacgaggtctcgcaacagccccgagtttaggcatcgagccctctttttccagcaagaagccctcaaacactcacctgatgaactgctcaacgaaaatatcaatttctcggtcgcctcggttctgactggacattttttggtgatggaactgatgctggagttttctcaaactttgcatattggacctaaattttgatgagagtcacgtgtcatgcacggtacagtagtgataatctatggagtcaagaaagtgcaataaatgaggaatctgttgtatagaaaattctcggacacaaatgatcgaacgaaaacattggatcgattaggatatctgtgctgttatactacccttggcgttttgaatagcgtgcgtgttgtttcacacacagagatatctgtacatacggcggttctatggaagccaggagcacttccaaaagtggagaacattttgtacaatctatcatgtatgcttcgatgtcatacagtaccatccccaggaaccctactccttcgctgctggcatctgcttgtcaataaataatctctttataaataattgttaacggtagaggcccagagagtctttatcggctcatatagactcggtgtcggactcagactcactttcggattcgctgaagtccataccaaagaaatctccacccttggccttcacattcgagctggaagatcctgcagaagatgacaaggcagtatcaatttcggatacagccagagcagccatctccgcgtcctttcgcatcttctgaacggcatcttcatggtcttccagcagtcgtgtgttttcaaacttgctctttcgactggacccactggtcttttccttctgcagaatgttgagcagcttctgtttcttctcttcggcctccttcttcttgatctcgtcggctgtgctgaggtactctccaagctccttggcctgccggatactcttcattcggcggccgtccagcgttcgaaaagagtcgttctccgtctccgtcttctttctattcttctttcgggccatacgtcctccctgggctcgcagcatggacccgaaaccaccctttccaccgcaaagacgcatattccagcgcaagtagatgtcaccagctgcagcagacaggctctcaagactctggcctcctctggtgctgagatatcccttggctgtggcgttagggggcagttctttgagagcgctttcgatagcgacgtggacatcatcatcagccaaaacgtgtttctggatatctctcagaccactgggggtggagatgaatatagtgggcatgtcggtggtggtggcgaggcgagggttttgtgtaccgtggtgttgtgctctggatggatgttggtgatacaaattatattatggttcagattatggtgcatggtacgagtgaggaaaaactcgaccaagcactacattacttgtatgtatgtaccgatccagaataagcactttggactggatgagactgaattagagcggttggtaactggttgtgagaaaataatatgggtagaataacagcaccaagacgccatcttcacaaaaacattctcggtatcaatttgtttgtcacgatcttctcttctgtaccgtcttgagagccctaaactgtagaaaaacaagaaaacattacaaaacgattcaacaaaggcaaactcattgtagaaagacgaaaattactacagtattcgagccatatggtagaggaacaccacggacgcatcggctcattcattcttatagcccctctccctttgttttctcatcgtctcggactcatcttcccagcattacaaaccgcaaaccctaaccgcgactgaaaatttaaccaaaataggccctagagcacaccaacagtcagtatacagcatcaccacacttgcacaaaaatgctggctcgactgatccgtccatcgctggcagcggtgcgtctgcccgcgatgcagatggccacattcaagaccatcaagcgagagccaaagaccgtcaacatctacgagcgacacccccgacgtctgggtaccgagaacgctcttacacacgtcactgacaagctgatgaagcagtttgatccccagggcgtcaagatggagctgatgaaccccaaatccgctgaccgaatcaagcccggagacattgtgcagatcaagaccactgatggctctctgttcacgggcctcaccatggtggtggacttccgaggactgtcctctaacctgctgctgcgatctaagatcaccaagatcggaatcgaccgacgattcaagatcttctctccaaccgtcgagtctgtcaagattatccgacgggccacccagaagtacaccgccgagcgtctgtactacatccgaggccacaagcgtctggatgttggcgatctcgaggcctccgtcaagaaggcagccgccaagcgaaagaagttcctcttcaagtaaatgtatatagtgaatggaaggatatggaaggagagctgagagtaggaatgatggagggctggatcactacatgtgtttgtatgtgacatgccaacatgggcagcttgcgagcagctgtgtcacaactccagtgttccaatattcgagcatggtcacattcagttccttacagtgtcaggcggcttctgaatcaatgccaaatacacaagtgcggccatgtgagatcatttgttcccctttgctctaaattacagtagcttatacagtggaacatctcatctctcgaggtttatctcctttttccaataaacattatcaactaaactgtcccattagttaagactcaacatgaacactatctatccaccaatattgttttaaatttgcttaaaagctgatacatctgacaatatcaccaaatgaaacaataaacactcctccgatcctccctcggtccctcaattctccgccttcaacactggccatatcgttaacgactcaagtctgaaagttactttgccccgagtaaaagctcgtatgacaaaacctagcaacatcgaagttccagcctctcattggatagttggtggtgtgacatctatttacacaatatagagactcaatgacggccacaacaatactaccagattgacaaacaccaacttgcaccttcaaacccaaaccgtcaataaggcaacttctagagatgctcatttcaagcacttccagagtggaaaacttgcttgcaaccatgtgaagttattgcatgaaaacgaagggatgttaaaggagtggaaagtggcgaaaaaataatttttgaaggagtagaatgaggaattggtgccgaattgaacgccccccagcgattggtattcacatcattcgctccgctatcatacccctacaatacctttgtcttaattccgctattgcccattaaagttacaagtagggtaagggggttctgcaaaagttttaagtggttgtcccaaaatcaagctgtgcttccttctctgattacacaccccacaacgcgaaatgttcttcaaaacgcttgctagtgtgcgacccgccgcccagcgagtggccacctccgttgccagcaacaaggtcctctttgcccgaggttacgctgcctttgaccgatccaagccccacgtgaacattggaaccattggccacgttgaccacggaaagaccactctgaccgccgctatcaccaaggtgcttgccgagaagggcggcgccaagttcctggactacaattctatcgaccgagctcccgaggagcgagctcgaggtatcaccatttctacctcccacgttgagtacgagactgctaaccgacactacgcccacgttgactgtcccggtcacgccgattacatcaagaacatgatcaccggtgccgcccagatggacggtgctatcattgttgttgctgctggagacggttctaagccccagacccgagagcatctgctgcttgctcgacaggttggtgttcagaacctggttgttttcgttaacaaggttgatcagattgaggataaggagattctggagctcgttgacatggagatgcgagatctgctgacccagtacggatttgatggtgacaacacccccgtcatcatgggctctgctctgtgcgctcttgagggcaagcagaaggacattggtgaagacgccattgtttcccttatggaggccgttgatgagcacatccccacccctaaccgtgatcttgagaagcccttcctgatgcccgttgaggagatttactccatctctggccgaggaaccgtcgttactggtcgagtcgagcgaggaaacctgaagaagggtgaggaaatcgagcttgttggctacaacaagaagcccgtcaaggccgtcgttactggtattgagatgttcaagaaggatctcgactccgccatggctggtgacaatgccggtatcctgctccgaggtatcaagcgagacgagatcaagcgaggtatggtcatcagcaagcctggtaccgtcagcgcccacactaagttccttgcttctctttacgtcatccccaccgaggagggaggccgagccacctcttttggcagcaactaccgaccccagatgtacatccgaacctcttccgtcaccgccatcctgactttccccgagggtaccgacgagtcccagaccgtcaaccccggtgacaacactgagatggttttcgagcttgttcaccctacccctgtggaggtcaaccagcgattcaacatccgagagggtggaaagactgttggtaccggtcttgtgacccgagtcattcagtaaatgtatatagtatctaagatctgaattgagttgacatacgaatactctcacatagacatagacacaatgggagaggggagaagattggtgtaaactaaccgccacagaggtggactgttcggtctggattgagtggtgtattatatgccctctacgctttgtccaccacatgtatttcagggcagcggctctctccgaaccagcgaaccatacaatcgagccacctacaggtgacccgacacagcgatgctggctagtttgccgacgaccaacagttactggcgacatatattgaggcatcatacacaatctgtctccgttcttgttatgtattgtcccgttcgttggattctggcgaaaacacaaaacaggcagttgctgtgtcttcgagtagttcttctgatctgagtacccgtttctcttcagctatctgcacggtaatataccagcaccggtacagatggctaatagtttgtgatcatgatcattcttaataactcatcaccccaaaatgctctccacctacaaagtgacactaaggaggagaaccttccctggccaaacaactatctccgtaaaaagtgcgaaggacgagtttatggcccattcgataggaaacagattgatgggcgtctcagaagtgtcactctggatcacctccaatgtcagagacgccgttccacaatgaaactcctgttcgaagcgctccacgtgttctgtaatacagtctccgagctgaagaacattgagaacttcccatttttttttctatacatcaattgagtgggatcccagacatcataatgtagattgtctcctcttcattgaatactccatttttagtcacccacacatacatattttatatatgacttgtcaggtaaacatgcatgaaagtgagtgatatattaccaaatattaacgacaagttgaaatttttttcatggcacgacaatatatcatctttcacttcttagtgttagtaatcacctctccaccccgcgcgccatgcacttcaagctaaatctcgaactgctactgtacctatacactaacctgaagaatttagtactgtacatacttgtactttcgacacaggacgacaagatcatgtcctggatcgatcgagagttggaggaatttaccaaggagtacacgccgttcgtcaaacatgtgactgtcgaaaatggtggctctttgaagatcgagtccttggacggggaaatacattacggcttcagttaccgaggatggatggacagatcagaatggacaacggtacccgacaagtcaggcactgttgtcggcaaactctcctgagttcgttcataagtggcacgaccagctgtttactgctcttagtcgcgttaaagatgatcaaaaatgaagctggagatgaagcatctttgaatgtctgacgcacccagctgggtgaagctctttaaagagattcaacattatccagcctatggcaggctggcaaagaagggatctggtatctcatacaatctcagaaccttcaacaattgaacgtcctgccagtatgcaaagtgcaagcgcgagtggacaaatttcactcttgctggagccgttgatccaagcggctatctgcttcacttcatacatacacacaaattgtcgctggtatttgaatccacgcggctcgggtaaaatacaatattttctttatgcctatttaatgttagttgtctatttgacggccttcttaacgtcctccttgtactcctcagccttctccttggcatcgtcagcaacatcctcagccttgtcggcagcgtcctcagcggcatcagcagcactcttcttggcctcatcgaatttgccctttgtcttctccttgatctcgtcagcagtgctcttgacctcggccttgagctcctgagagtgctgcttagcctcagcctttgcttccttcagtcggtcctcctcctccttcacaagctccttccagtcatcgctgtgctcaagctggacgtggtggtggtgaacctttccatcctttccaaggaagtctcgagagttgttaccgccgccaaggttatcactggcagagaaagcaagagtggcaaacagaagaatgattgtggaggcctgggcgtacattcgagcctggacaatcttctgggtactagtcatgtacttgtctcggaaaacataccacatggaaccagccatggaaacaacccaaccaccaaagacacacttgtacttgtgttccttgaggtagtgcatgaatccggcttgctgctcttttcggtgctccatgtcgagatatgcaccagagtacttcttgtcgtcatatgcctctccagccttctcagcaccaattgagaaaccagccagaccggggacaatgccggttccgacctttactgttgcactcatgtttccaaacagatgaggctgtcgcttcttgagagtgaatgccagaccgatacccagcagggcaccaacaccagcgcccttgataccgccaatcagacaggtgtggttgtattctttgatttcttcgggagtagcgactttcattgtgtaatgtgtaggaaatgtgtttgtgtgatgatgagagaagactgaaaccgggaaatcaacctctacttatacgcaaaaccgtcgtctagacgccttgtaatttgctacactatatcaacatcagactttggcttgctgcagaggtctgtaatgtgcggtcagcagtataccacatacaacaaattgctgtgacgcttggaaatacacatctaaataataggtatgggttattctcaagggtttaaattgatttctggccgtttaaatcaagccagcagcctcgttcgtcgtcccaggacctctagtgtcctccccgaactgttcccagtgtcgtgcggctcggaaatatatcttctctaaacagagttccggtagcctctatgttgtgcggctcgttaattgcggtttttcagggcaccacccagatacccatttggtgcggctcgtgaatgggtccccgaaggaatgcacttcatggaccactcagacatcatacaacgaatctaactgatatgttatgcggctcgcgtcttccgctgcaacgtcttcgcgtttctttggcaactacaccgttgagcactctgttattatgacctgtctatatgccgtcagataagcattgacatgcagaaagccagctagcgttcattcgctcccctctcgtctaagcacgccccgttgcaattgcataaacagttagaggccgtggatgagtgaacgagagcgggccaatgttccataaccttccaacgactctcagacacttactgtaatcgcagagtgtaacgctccaagtctattgcacttcggacgggaaaggaaggcatctccacattagccctccgtgctccttgtaaacgataggttacactaattcgttgaaatgggctttatctaccgtactactccattgtactgtacgtacaaaacggtatgtagctgctggtagtttctgcgtcttctccacacaccatgctgctctcccacattttctctactgctgccttggttgcggctcggcacagcctttcaataccaaccttgtcgtgggctgcggctcatgaaagagaccaaaacggaagaatataacggatcctccgtccatctgacatctgtacattatttatttgttccaacacatatgtgtcacggcatcggagttctttaaccgatctctggcttacattgattttttgtctcaattttttaaggtcttgtgcttttgctataacgcatctggattgcgatctctcatttcttttgaccgtttttttcgatcgcgaaaatacacactacttgtaccgcaataagttcgtcaagtgaaaccccccttgatattacatcattgcgcatgagttgagatgatacctggcgtttagtccttatgaacatttacagtcacactacaagtaattagctacatatatcatcagaagccgtaataattagcgccgttaaccacacccgtatgtacgaaaatgtgcatgagggatattcacttgtacaggattattactaaatccggagattgcagcacgcaagtggtatcattttttgtagcgtcagaaaggtattcgtacgagtacgagttcaatagtatgtacatacttgtagttatccttctatacttgggtagattccgtgcagagtggtgatgtggcaagtacgggtttaagacacgttcccgggatatagccgttcaagtacaagtacaagtactgtatacaactattgattatggatcatgggcaatgtttttctattagtctagtatgtacaataaattagttcttagcagcgttgagtcgagcctcctcgtcctcaagcattcgcttccaagcatccttctggtagtcgtaagacttgatctggacggggtgcttctcctcgtacatggtgagaccaagggtaccgagcaggagtacgacagtgagggcctgggcgtacattcgagcctgaaccaccttctggggttgagtcatgatcttgtctcggttaatgagccagagagaacctccgacggaagcagcccatgcgccgacaatcatcttgtatttgttctgagaaacgtagtagaggattcgctgggaagtgggaagagcctggatctccttctgtcgggcaatctcatcggggtggaggtcaccaaacttgtaggcctctcggtcataagcaaaagatcgctgctcagcagaaaagaccataccaatggaggcgggagcgagcacagtgaaggccttggcgaaacctccgtaagttcggtagacaggtcgctttcgagcagcatacagaagaccgaaaccaacaacggtaccgataccaagaccgacaaagccgtgcttgagaatatcgttgtagaaatcgttggtttgttccttagtaacgagcttcatgttgtttgtgttgttgttgttttgattgtggaggggggtttgtgatgtatgtgaatactggttgtcaaaagtggctgaaaatcgtctttttataatagtgcaatttttaggttgtgtgtgcccggcatgttccgtgatcgcgccacaatccaaacatcaaactctaatgcaattaagctcaggtaattgtggcttgtgactcagagtattactaactcttcggaagtggcggaaatggcgggtttcctgtatcaaacgatacaacacagctaatgctatgaaaccacttttaataaactactccaaacatcccatttactatgatatcaataaagacacaaataaattacgccacaatttctctttttcctctttccaaatgttgctatttttgccgtatgcggcgcttcaattttttccgctacgtcatgcagtctagaccattcgatttgtggcgcacggactggctctctttcgatacagacaaccgcaagtatccgtaacaaagacataaggtttcagccacggcatttcagcggaagccagtagcacacaaagaaactcttagccaccacacaaaaacggcaaaaaagctccgagcatacaaaacaagaccggatgacaatgagaatcggaccataaatacaaaagtaatagcagataatcgatttttatatacagctacttctttacccgtgtgcttgtttcacctcctggtcggtgtctgagagaagaaaaaaataaggagcttggcacccgacggaactccttccgatccctagccacagacctaaaaccgattagacgcgattatatttttggtgaagggtctcatctgcaccgccatgcgtggaatctggtcatatgtggctactctgagcagttcgggaaagacctcgtctgccggaaccccttgagcaagcattgtccccacgacaccagccacaattggtgctgccatcgatgtaccggataaagccattgttccatctgtgttagaatgacaacgtggtgtgtcaacatattcaagttgggtaggtacttacagtcgttgctgagggactggacaaagacccctgaggcgaagatgtcaacacagctgccgtagttgctgaagctggcgatggtgtcgcccctgtcgtcaatagcaccaacagtaatggacttgctagacgatgctggactcgatgtacatgcagggacgccactattgcctgcagccacgaccactggcaggcctgagtccacggctgcgtcgattgcatcgttcaggagacggttgtaggttgcaccaagcgaaaggttggcgactgcgaccaggtccctgcgtgcccggtcattcgccgcaaagtcaatccctgcgatgacctgcgaaagtgacccatcgccgtttcgcccgagaaccttgacttcgataatgttaatccgcttcgccacgccataagttcgagagccaaccaggcctgcaacatgagttccatgaccgttggtgtcacctgacccttctcccgtgaagtctgctccagcattggctctgcctccaaactcggggtggtcaacgttaatgcctgtgtcaatcacgtacgcatggacgttctcggtgttatatgggttatgcacaaaccacagcggcgaattggtgccaagaggcggcgatggcgcgtcgtctgcagggacagttccagagacatcatcatctggaagtcttcttcgagaccagagtcgcgccagatgtctgggggcgtcgttctgtctgagacggctggaagggaatcgttgagtggtatggaccatgacgtcaggactgatgtctacgacccagggacatcgtcgcagagtcgataaaaagctggaatcaaacgccccactgaatcctttaaacttgccgaacgcaaaagtagatttaatataatctttggcttccgggtacacacccaggtatgcagatacacttgcagtgtctgccagcttgacgatgaggtccagcttcccgatgggcaggctgggctggaagagattctgttgggcctgaagtgggtcatcaatggtgaagtttctgggttcttcaatgatatcacgaatgttgagggtatcgccaggattagaggtatctgggacatcgagagcaaagccgacggctagaagggtaagtagatgaagcactctcatcagtcagtggggtttctcagaaggtatctgtagtggtgttggttagccagggggtatcttttttgtgttgtgaacagcggttgtttaagtgaatgtacaagtaagcccctgcggtttagagtgaagggtgggtggttggtaaatgcatgctacacgtgacctcgtaaccaacctacaagtaggacacttacgtgtaagcaccaagatagcggataatcagatgccccttacacaggaaagccttaatagatatactcaacaactaataatggcaaaaaatagtccagtgggcaaagaaatggctgcaaacaaggaaggatttatacacgctactgtttcagcaggctagatcaaccaatcaccatacagctgtgcaccgccacaatcaagactctacttgtagtagacgatcaactcgaactagtacttgtgccgtactacgaaagctctaataactagcccaaaggctcgtggttaattatatatagtgtacgtgttgatgttgtacattgtgccgcttagcactgcacgtcagcaccggccttggagttgagcagaagagcaacaataagaccatagagacccaggacttcggcgaaaatgagaataagaatcataccaacgaaaagtcgaggctgctgtgcggtacctcggacaccagcgtcaccaacaatgccaatagcgaagccggcagcgagaccggacagaccgacggacagaccagcaccgagctggatgaaaccggcgtacagagaagattgctgctggagagatccggagataaggacggaaacaacgagaccgtaaatggcaagaataccagccataatcacggggactgtgttcttgatgagcaggtcaggtcgaaggacggaggtagcgcaaataccaacaccagacttggcggttccgtaagaagcgccgaaacaggtgaagacaatggcggcagtgcagccgatggctccaaagaagggctgagttagtaagggttttgattgagtgaatgtttctgtaattagggggcgatgtgattaggttgatgtcgtcgtgtcgttgtcgtgcgtcgataactcggacatgcccacactgtgttattcgcaagccatcacatggaggattgctatgagcgttgttgtcggtctgcatccatcacacagtcgatttatggccttccatcgccacaattgtcgcatccagtcatcatgtcgcttgcaatgttcatgcagcgacttgtcgtcgagtacttacagcatagacggggctgagttagtaaatggatccatttcgggggactgcaagtatcgcagttgcgtgtcgcagcgtagatactcaccagaattcagtagcagtcagagccatcttgtcctttttgtgtgttagtggtgagtgatgttgatacctcaatcgatgacaagcgtcgaacagtgtgtgctgtgacgaggaggcaaccgaatagagttatggtagggtaacttaggggagttcccaatgatagcgcagagagtagaataatggtgctgttagcgtctgagttaaactggtgattaatgtcaatgacggacggaggaatgttgaagggtggtctccagattgaggttcgaagacagcagtgttcatgtcatatgacctgtcgtatccattttaattcaccttgctgcgatctaatgttgtgtattggcgtgcgattcggtgacccagaagtctcacgcaagaaaccgttaatgcttgtatgacttccggtttcagggacacttacaacggctcatctcagctcaatgagatccactttgtagatagactgtgtcttgaaatattagactgcaaatatgatgctgggttggagaccttatgatgagagatggctaaactcaccaccgtacatctaactaacgcataagacaccagaattctcatcggaaaacacaattacgcttcttgagatacctacattacattgatttcacttttttctccaatatctccacccccacctccaaaacactctttgccaccatccactcagaccattaaactccatgcgtctaaccacaccctcccatcttaataagcacagtgtacgtcgtcttctttagggcaaccttatttgaaatttttgtctgcatgtattgggatattttcccactttgaattcttcttctctaaggcgagctttgcaaggaacctttaccaccaaacacactaaccatcaaaaatgtctgagcccaaccccaaggccttccccctcgccgacgctgctctcacccagcagattctggacattgtccagcaggctacccatcttcgacagctcaagaagggagccaacgaggccaccaagaccctcaaccgtggtatctctgagttcatcatcatggccgccgacgccgagcccatcgagattcttctccatctccccctcctctgtgaggacaagaacgttccctacatcttcgttccttccaaggttgcccttggccgagcctgcggtgtctctcgacccgttatctccgcctctgtcacctccaacgatgcttctcagctcaaggaccagatcatccagatgaaggacaagatcgagcgacttctcatttaatttaatgtattatatgacttcgaacggaagccaagggcgtagatctgagcggacaacagcggattttcttcaactaggactgtaggcttgggtagatgcgatctttagtacaccatagtgaatcgtccttcttgtactcgcatcacttcgatgatctctgtagctacatttacgagtaatatgtatatatatatatatatatatatatatacagtccatgacttaggttgggtcagatcagttccttgtctcttagacatgagatacaagatgcctcggggtagttaattattgtttttttgcagccttagatcacacacacacacacacaaaaatgaaccaatactaagcatttccctttttcttttcggcttcattttcaaagtcgaaaaaaaaaaattcttccgggacccactttcgttctttcaatggccaacgtctatcagccgcacaactgtttgccctgcacttcagactgcatatgaagacaacaaaccttgccacagcatgccatgaacaaactaaagctggtgaagacgtccaaggagctggcgcttcaacaaaagcgacaaggcggtgatgccagctcagatgagccgccaaagcagcagcttcacatcaccgaacctccgtcgattgtggcgtctgaaacaggcaacctcaagttggtggtcccacagacaatctcagaacacaaccagctgattgtcaatgagcctgtggcgcgccagaaaccgaggaatcctgtcaagatactggacgaagatgattatgcgcaaaaactgaagcaaatcatcgaatctggaggagatacaacggcctttcaacaaaaacacaccacagaagataacgcctcgtttcagcagctgatccaggtggataacgcaagaagagacgtgaaaacggccgacagattctcaaccacaaagctcgacaatgactgggacaagcccaaccccaaaagtgccctattcttcagaccaaaagatatcccccaggaaccgtctcttagaggagagatcgccgtggaaaataccattgtggtgaaggagaatgtggaggtggaggaccccagcaagaagtcagaacagattgctgacgatatcattgctgcggtgaagggcccgcatgttgatgggtatccgttcgtgaccaaaaacacatataagatcgctccagagtccaaggagtccatgcttttgagaaaactcactgcaaagaagactgccaaggtcaccggagacgtgactccacgaggtgacctctctccagcaggtagaaacctcctgaacaagatttcaaagaggagaaagtgatttgtccctgactctctactatttattcatattatttatacattattcattaaatcacaaccactactgcctcgtataatgcttccttgtcatatatccatattctattcattctatcactgtcattactcattaaaggatcctggacttgtgggtccgttggtcctgggttggttaaattcgatcatccaacagcccctcctcgagagcctgggtctcctgggtccactgaccactgttccatcgttcggagaagttgccaaagaaaccctttatgttattggacatttttgtgatctgggtatcgggggacgcgggaggcacctcgaatcgagggttgggcactcgcacgcccccagagcttcgtccattcatttcaatctctcggaaaatgagatctcggccttcaatgtagagagaggcgtcgtcagagtcctcctcctcatcggtgaagtccaaaccgaagccgaaccagcccttgatcttgtcgtagacgttgaacaaagtcaggccaataggcacgaggatgaatcgggggattccgtcggaaaagaaggtgccaagaggagtcaggttaatgtacttgcccaggaacgcttggaaaacggactctcgagagggaatcaacatgaggtagttgtaagcgatggggacggtcaaacgacaggcgtacatggcgtagaagagcatggacgacgcgtcagagtgctgtcgaaccaaaccgtagacgttgaagacacgcactcggaagagggacgacactgcagtgtagcacatgtatccgagaataaaagaagacacgacctgctgaccaaagccctgcgtggacgaaatgataatgttgacaagcgagtacttggttccatacagcaattcactccacaccagagtcagagataacagaccccaaaaaacagctccaagacgcattacccagggctcaaccagagagtagtaaatgtgagcgacatttggcggcagtcgagtagacgatcttcggaacttgaggtctccgtgcgagttgacaatgtcttcatctcgcgcagcttcgtccaccaagttcttccagtccatggtatatcgaataagtcggaattcagccttctgtaacgatctctggaggtttgacagatactcttcggagatccgggatcgctccacggtggcgggacgtcctctgggaggcagctggaccacattggaggtgtcttcgatggagtcacacagctcgtcgacccagttagtgtactgggtgtgttctcggtggactctgagtgcaagcacctcgttggacacctcaatgtacttttgctgggcctcggcgtatctgtcgtgtaccgagacggcctttctgtagtgctgtctgacacgttcagtgggggccgccaggatccagagtcgtcggggcacattgacaaggccgtgacccatgaaccagatggcgaaaatcagcgtgtaggagtatgacagggcaattgccacctgcttgatactggtgattgacaggccggtggagatgatggtgtagatgagtccaatgagacccacgcccagcaaaatgccctggtacttgaggttgtacatgattgcttcccgggccttctttctggggtcgtggtggccactttcgacgtagctctgcagcaggggcaaaactgcccatgtcagcacaaatgccaaccagtaggagactcgccagagaatgagacgcacgttttcattgagatagaagagcgggtggccctcgccattggagctggccgatagaaggtcaatggggaccagaacgacaatggagaagggaatgtagactgccagcaccaaaggcaggagaatgaacagcggagtgctcttgatggaggagtactgtgagatccacagaacggaacacacggcggtggcgcagaaggccagaattggaaatagctgtgttagcattgggaaaaaagaagcggccgcttcatttgcgtctctctcagttcaactcacaatcatcgcgtggtgagagtttggtcgtgttcactggcgttatgcagttagttcgtggtccgtcacgtgatgcctctgggacattgcgatattaagtcgccggcgagcaaatggaatgtggttagctaggtaatattttggttctgacggtaaatactccgttacgtgcttccttttcatttccctctctacagacacattgttgcaacatccctctccaattcatgtccgtgatagtgtatgaccatgcatgcatattatgaatcgcagcatacacaattagttccccagaacacaacatgtctgagattgctaaagcattggatgctatgtgagtacgacgagacaaaccaccaaatcacactaacacaggctgcaagactcgggagagctctccggagctattgccatgagacccgattatttgtgcatcggaggtgagtatgagtggtggatggagtctcgtttggacgtatctaacacagctcgaggagtcgctgtgcccaaggacgctagccactttgctgaggcagagaagttgtttgattctgacggctgtgtgtctattgaattcaaggattatctggtgactcttcagaagggtcatggagtgattattggagtgtaccgacctaaataagggtccaatatcgatacgcagcgagccccggatgagcatgtgaggcgaaaaggacctgttaatttgagagatctcaccacatgatcttgagggtacatagcgagcaggtgtaaaataagtatatatgatgatgtatagcgccattatgagaaaaggccagcctaatcaatgcagcgatcttaatagttttgtgttactggtcttcttcatgtgcaccggctctgtcagttgtatactacaatgtattggctatctatgacgatgtacaagattaatttaactgtttgtggaggctgtattcggagatgcagactgagtgcctacgtcttcttgcacacccctctatcttcctcccagtcccttaagggaggacatggtagcgacactggttcgagcaaggcgcagctcggacatcaccaattcatggatcttgaatgtcttgcgccagtcattctgatcggaggagtggtcaaccatatccttgatcagctcctcgccttgctcgaatgcaggagtgccctgggacttgtcccacttgtcgaatgccgacagcagagtcatgaactgtgacgtggagaagttgaactgctgactgatgggcgacacgtagttgatgagctggtggatcagcagacccaggtactcggtgggcaggagtgggaactcaaacagagccagcagatactcagacgacttgaccagctggccagagcgtctcaggttgaagtactctgtcagaacagcgtaaggagcaatgcattcggccacctctgcaggcacgtcagagacagaggcaggatccttaacgtagtctgccaggctcttatctccttccacgggagactcggccacaagagcatttttaaacagcttccagcagtggtatcggagagctgcaatgttgccgttcttggcaaacatgcagagacccatgagattgttgttgttgtggatggccttttgtgcgagcgtctgaagaatctcggcctcgacttccactagtccgttctgcttacatttcttgatggcccagtcgatttcacgggcagaatcgtagggtaggcgaggcagcagcagactgagaatctgacgggcaggggcaacgtctcgcagcttctgcagaacctcgattccgacgttgatgagattgtcgtagccaatacactgcaaagcgaggttagtgagatggtaatcgggcagagccgcagggttcgcagccccatatccattgagaagaccggcatcgtagcacatgttagacacaagagcagcaatgactgaatcgcagttctccagggtttcaatagccagcagcaatgaacccttgatggcgtggctggcccctgcttcccagacggtaaaagtgtccaccggataattggcaacagcggcatcatagtagcccttcattcgagaatcacagggatccacgtactgctgctgggttaccagagcatcgtaccaggtgtgattcgtgcccatgatggcgtcttcgtctccggcaagcacctgaagcagagtagtgagtcccttctggatctttgcgtcgttgatcttcagcagcttactctgaacggtactaatggagttgtgccattgtcggaagtaaaaggatacgtttccgggtccctgggggtatctgctgagaatgtcgatagtctgttcgagtgtttcctgacaggaaggatcgacttcccctgctccactgttatgcaagcaatgagaggcttgtttgagcatacctcgacagaccagttggtaaatgtacttccaaaagtccttatgttggaccggcggggtctgtgacatgacttccttgcccagctcgacactgggctgctgttctgagacgttgacccattccaccagaggctgtctaacctcgtatgtggactgggaaccaaagaaacctgactgcccagcggctccattgtgaaagtacacggcgtaaatgcacagagcaatactgtacgcgtcatccagaggctcggcttcgacaatatcgacatccttccggatctcctctcgataatgcttgatgctctctatgaagtctgcgaatcgttgcgtcagatcttcagcggcctggggaccaagtgtcgttgcgaatgcttcggccacgaagcccttgtagttgtcgctccactcgtctccgacgcgtgtggttgttggatacagagtccgatcctcctttgtagcgtgtccgtcttgcccgggctttgcatcgaaccaagcaattccgcgagcaatcacgggatccatgacaaagcccatgtttcggctcttctgccattcctccacctgcccctcggggatgggtgctcctgggagagttatctcaggcagttctgtgtcgtcgccgtcgagaattgtttccatttcggcctcaccaaattctctggcggtcagtgggtcgggagatatgtagttgtctgcgccatttatggtggctggcggtgcggaaaacatggtagatggctggaaaatcaccactttgcgatatacacaatcttttgggaattttgttgcactgcgcctaaacagtatgtttgcggttagggctgggttggttgggagaggctagtgtggattttggctaagtattggataagtaatgttatttttcaaataacaattccccatttagattgtaaataacggataaatggaaggtttgattttgttagaattacttgaagaaaattagattggcggacaccgacatgttaaatgacgtcaagatatgcacctgtgaaatatcacacataaagtcgatgccacagtagcccagtagatgtgtactcgaacaattgcagatatgagatgaggggaatatagacccgaatcccatgtaactaccgcgaaaacaatgtccgcctttgtacaatcactacgcgacacatctgtctccaggtgctaccgtcgtaacctgtaagctaccgcatgctcgagtcactgaggatctgcagtgccctattcatcaggagtgacggcacgcctggtatacgcgtgtagtatgacgttcttgccggggagcacgtacagcaacgtgttggtgatgaattttgctcattccaaagccctctacaaaggggtacctggtccttcacagcctcaatttacagtctcttttatgctccgtgcctatagtgcggttaagctcggaccattttggagctgaacatcgtgcgtatgtcgtacagttaaaatggaaggttggtggaagggaggaagcaataacagaagggcgtgaaacgaagacagataatgatactcgtacccgtagatgaggtgaggacaaaaagctacgacgtacaaaaaaaatgccacaaattgacacgttgttccacattgcagtataaccacccccacatttgctacaccctatcgcacagggcatcacacgctgcatccgagacagtggggagcgtaatacaccgccgaggcttttagcacttgaagctgctctcgaccagtgggtgcagtggtagagaataaacacgcatcacgtgaccggatatgcctctgaaatgtgccttgcaatttgcgtggacggtgaaattgccactggagatatttatagcgggcagagttatttatagatgtggggtcaggttgagcagtgcaactgagcagagtggtttacgagtaagagcggtggtccattccgggagagaccaagtgaggttgctcgcgatggggctgaagcctcgctcatcttacgtgtacctctcaaagcccatatggcatccttctacggcgtcctctattttgcttcgccagagacaagcctttttgttgctgctccaactgtagctacgtcatgcaaacaaagttaggctcagacaatcgaagacttgaacttgggacacaggagcactcaggaaggaggagagtagcaagtaccgacagcagtacaagaacaagtagcagcacaccaaacagcagcagcactagcgttctcgaccagcagcagcatcagcagctacagctacatcagcgccgtgcatcccagcatcagcatcagcatccctacgacttccccacaacagtaggtacgtgtaccgacagactgaccgccactaccgagcccgggcccatgtctgtatcgccgtactctccctgctcgccggaggtgcgattccccatcaaagagcagccgtcatatttcgaagctccctcggccgtcacttcaaatacacacacaatgaaggctcgcagtcaatcgccgacaaccgagcagatacctccaccaatagcgctgccatcactccagctgcgtcgtccctcgctacccatcacttcgctggctcgagaaacgccgtcccagatccgggcgctgactccagaccagctggtggacttgctacagcaagctccaggcgccactgtggtcgacatcagaccctactgcgactacacactgtcgcgggtgaaaggcgcccttcatttctgcatcccgtccacgttcctcaaacgggcctcctactcgttccgacgcacggtcgacaacatgctccccgagcagcgccatgcctttgacaacctggccgacctgccacctctggtgatctacgatcgcagcagcgagcacttacagacttctcagagcaacctgtaccatacgctgatgaagtttgtgactgctgagggctggcctgcagaccaaactgcccactacttagtcggaggcctagatgcctggagcaggaacgacagagtagcagcaaacgggctacttgactcggaaatgtataaatgcgagggccgaccaccagagtttggagccattggattcactcgagccacagccaacctcgcagacgcaaacgccatccccttcccgctcgtcacgtcgggtctgagacaaaacccgcttttcaagtccgtgcgggcagcaatggaggtccaggacgatgagtacattgaagtgcaactgcctgtggacctcgagccgtcagacaaccacccggactgggtcaagacgattcttagtgaccctctggaagccagcaaaaagatggctgccgagttccggagtctggagcaggcggaaaagaaccggatgttcggcgcgctgtccattaagagcgactcggaaaactactttgatcgacgttactccatttcaggaatcgaactgggcgtcaaaaacagatacgacaacatttatccttatgaacacacccgggtcaaattggctcgaaaaacccagggatgtgattacattaatgcctcgcacatttcctcagcacacagcaagcgggtgtatatcgccacccaagcgcctctgcctgagacgtttgcagacttcttccacatgatctgggaggaaaaggtgcctgtcattgtgcaactggctcccgagtttgagggagccatgctcaagtgccataactactggggcgaaggaacgcatggaccttacacggtgcgcgtgattgccaccaggaaggaggacgtggacaccaaggacaacattgtggctaccatccggacatttgaagtgtcacgagagggcgtggtgcggcatgtgacgcagatcttctacgatgcttggcccgatttgggccggcctgcaaaccccgcagacctcttgaggttgatggagctcaaggacggtattttgaaacatgccaagcttcccgtggacggtaccaaggtggttgtacactgcagtgccgggtgtggccggacaggtactttctgtgccattgacattgtgtgcgacattttgcaacgcggtgatcctcagtaccagcataaggatgtggttgccgaggtagttgccgaattgcgaacccagcgaacctcaatggtccaaagtctgcggcagtatgtcttgtgctacgactctgttcttgcctggttggctaagcgacagtagtcggaacgcgtaagtacgcaagtatatatttattcattcaatgcatcattgtagagattcagttggtcggtaaaaaagtacctactgtatgtataggtactcgtacgggcgatacatacgatactatacacagtttgtaggagtgtcgtacaatactagtatatagatgccatgtgtatatgcagtatgccccgtatatgtcattagcataaactttattctcggggatacgatatgattttctggggtaagaaataggtgggataagagacgagcggtgaatatgacaagaaaagacggtttatggggggggttgatttgaggccgaaccaagaaactgaccaaggtacaagatgataaacacgacagacacccaccagctggatagacacatacattaagcattgctaccgaccaaatgcgattccagaagattggaggtgctaaacagggaagcccagcaactcgggtaaaacgaagctagacaaaaaagaaatcagacgacctcggagagggtcgaactctcgatcttacgatagcggccattcaggtgactaacagtcgtacgccttaaccaacttggccacgaagtctgattcgtgatgcggcatgtcaaaaatctcttttatgaggccaaatatgaaagaaaaccgcgcgaattttgtcattttgagggaacagcaacactataacgccgatttgctagtgaaatatgaacttctgaattctctaggtccaattttgagggtttcgtgatcggattggtttttcttgactgtagatccagacctcatatacagtagaagggatagacctaaagaggtgctatatttatgctattgacaagaatttagccatttttgaactccagcaacgcttaatatagatacttgagtgggaatttgctgatacagtagctacaagtataggttagtcaatacaatatgccgtcgttttcatatttgttgacaattgaaggctaaaaggaaggtaaatgatgccggaaatcatgaagagatcttaaattgaagtcaatattcagctttggattaattttgtccctcttaacttgtgaaaagatgtggaagcatcagttgcagcaatctggagaaggtggaacctctactgcattccatatggacggctatgctatggcgatgtgacgagcaaagaatgagaaaggaattgtggaagtaataatgattgaatatacaaaatgtgtgaatccgtgcctcggttatataaacaccgtcggtactccaaatttcacagtatctcagatttcatataccaacaatgcttctcaagaacatcgcccttatttctcttgctgctctcgttgccgccaacgaggccgtccccgagtccgctaccaccatggttgctgtccctatctcttccgaggatcactccgagaaccctgaggacatcaagcagttcatgaagaagaagtgccccgagcagaagtgccccaagcccaagcgagtcactctcaccaagaacatcaccaagaaggccaccaagaccgtctacaagaccgtcggctcttgcgagactcaggctcctcagaagaagtgcggaggcaagaactgctagaattcgactctagcaatcttcaaagcacctacaagtagcacaactaatctttagattctaattgtactgataaatacgagtctgtagacgtccgaataactaccaataccatctctacacactactgtactgtgcactcataccatcatcagaaatgccagttggcagttagtctatttacatatgtacagttggattaaagagagccgggcaacttggttgtctttctcttgtattggttcttggcaacctcctcaaagccgttcttaacgacagaggcattgtgcaatcgagaaacaatgttctggaagggcactcggggtcgcttgagctgggctccaaggtaggctgccgcagacaacagagcaagagctccggcctggtgagcggcagccagaggagtggggacaagatatatcagagtggaaatacccagagtgacctgaaccatagcgatacccatgatggagtggcaggccaggaaagcctttcggggcaagaagggcttgaatctgttagacatcagcagcagagcaaaggacgcgcagaatgtcgtagtggcgagcactcggtggtcaaactggacagtcacggggttctcgaagatatttctccaccaaagatcagatttgtcatttttttgggcgaacagagggtccatgagctcggtcttggggggaacaattccctctcccatgaaggggaaggtgttgtagatcattccggcatcgagacccgcaacaaaggctccggacatggcagtgaggaacacaaggccgcagaagactgtagtgtatcgcttgaagggcttgaggataggattgttgagtttggcgaagtcagcaactgcagaagatgggttggcgatccatcgggattctcgcagaacctgaacaccagtggagagcatggcccagtacagaacaaacgccgctccaagatgggtggccagtcggtagggggatactcgagggtgagagttatctgtctccatgaacttgttgtcaagacccgacttcaccatccaccatccaatggctccctggagaccaagcaggatagaaatgacaccgagacggccggcgatattgggagagactcgctttcgggcaacaaagtagacggcagggagcacaaaggtgagaccaatgaatcgaccccacagacgatgggcccactccatccagaaaatgaacttgaactcggaaagggtgatgttggagttgagcagcttgaactcgggggagtccttgtatttgtcaaactcctcgatccagtcggcctcgctcatgggaggcagggatcctgtgacaggcttccactccgtgatggacagaccagactcagtcagacgagtcagaccgccgagaacaacaataccaaagacagagacagcggaggcaatgagccagtatccagcccacttggacgagttgacaggccactttctgggagaggccttggggtcctcattgggatcggattctcgaggcttaatcacgtggacgttggatcgctggtacagggcagcgactgtggagaattgacgggtcttgtcgagtctgggggctgacgctcgagttagagcgccgagaacgcctccacgagacacagaagcgacctttcgacccagagtgagggcaggcagagccgaggtcttggaggccaccttggcggctgtggttttggcctgcagcacggcgaggttgccgttgaagtagaacctcgatcgggcgaggagcattgttgatatcagatgtgatgtgtgcttaggcttgtactccaagtagtcacgacaaatctgacgatatttttatgctgcacatactttgggtttttgacggcagcatcaaaattagagttgggggaagcaaaaaccgacgtatggtagggttggatttgtaagactacgatacaagcgtagtacaacttggtgagaggattactgtaggacagattgtagaggagagggtgaggacaagattggtcacgcgtatattattagtcacagttttaaaacacatattccgctattttccgatggccgttcacacctgcatcatccgattaaaagcttgctccatatagatgtctttcctacatgtccatcacgagcaactcatgccatactacaaagtttaggggatacaacgggatacaacgggatacaacgtagaagaacgagttaggggttggaggggtgtttcaaggggagtaattatttcggtcagatcacatgaccacatttctctcctcgttacacaataaaatggtgtctgatgcctcctttactcgtactagctgacacacaccaccctccgtacaacatcaatgggaatatatattcatctagtgttttatttcaggactcggaagagcttgtcagcggtgttgtcattaatgcaatgctggaggtggaaaaactcctcgacacagtcctccttgtactcggcgtggtcgtagtcctcagcctcctgtgccttggtgactcgctcaacacactcgtcaaagtggtgcttgaaatcgtggcaggggccctcagcggcggctatgttagtatgtggtgtggtggtgcgtcggtatacacttagtgatagttgaaactggagttgagatatcaagtatagtaacctggcacaacatcacagcatattgggagaggcatgatggaccatactgaatcgaatcaggtagaggttgaagacgagttggaccagcagatcaaagagcacctcgtaatgctctggtaccctctcctgtgtcaacgcgaaacagggatccgcgtctcaagggatgaggcatctctgaccacctcaaacacaacgtacctgtccaatcaacgtccagtcctctccgtacctgttcaatcctgttgtatccgtcctgtaggtgtcatcacacactctctgtcgtgctttctgtcgtgttctcagctgttgtatccggctccctacttgttgcttcaactccatatcctccatatcctccatatcctccatattcacactcaatcaatcttctactcaccttcgtgaagagcaatggcgggatcggggacctcatcatcatcatcatcgtcatcatcgtcctcatcctcctcctcatcatcgtcctccttctcttcggactcgtcatcatcggactcaacctcgacgggctcgtcctgctccttctcctcctcggaagcgaaggcgacggtggggaggagcgactcggcaacctcgctagcaagtgtcaggaaataagacattgttgtgttggtatgggttgtgtggttgtgacaatagtaatgtgatacgatttcactgctgggtgtggtacgcttcgaaaattaaacgcacacaaatctacacttagagacagctgattggctgctgccggcgaacaccccaaagtttatttaccgccaacaaccactcgttccactgtgagagcactttacaggtggttccatatcctctatcgaaatccctcctaccaataatattctctggatcatttttctgggcacgtgactttatttctccaatttccgtgcaccatcaccgagttgaagaggttggagtgtttttaacttgtttcgtttcccgttggttgaattctccgtcctcccaattgcctcgacctggaattgtcgcgcttctgtatggctggtccacaggttatgagtgtaatggaaatggagtgatggttgtttatgacttgagtccgaaaacggtgggttttgattcctctcacttttgctacccattttcagtctgtttgaggcaattgctccaatggcctgatcaccacacacgagtggggcataagttggggcatctggagcatgaagttgggttaggagacaatgctacttgtaagaggcgagctgacaacagagtgactttcagcttcttcatatgactactttctaacccaactggttcagagggataggaatatcttgtgggaatatttttaaacgggtggattgtgaccttggtgccagtgtcgtgaactgagagcggtacgacctctcaggcagtgacttcacttacagcagcagaaccagatcgtagaaaactaatactaagcgaacatttaagatgaggccgactattaaaaacacagtgagtacgtacgtacagtatgtattagctacaggcaaatactacttgcgacgaacaagaccaatagtagatgcttctcctctactcatagcagatcgaggacagtgacgcggtcgcaggagagttgtgattattggtaggtgtagcgcacagtagctacttgtactacaatatgtactcctcgtacaagtatgtactgcagccgataagagatcatactgtagttacgaatgttgactagatttctgttggttaacgtcacaagtttatactcagcacctacaatttgctgcaggaactcctccagataaaacatcaatgtgatcttttcacctatagaagaacgagtacaagaactcgtacgtcccacactatatatacacataaagattgctcgatctctcataaaatataaggactatctgttgatagtagtgctacacctacataatttcactgagatttcacgggtgcattgctgtgtagctggacgggagcatccagttcagacaacttactgtaatgcacaatctctttttgattcgaatgattctataatatccatctctcatgctacaccagttctcaatatgtaccggtactcttgagcacctgtgtcaaaagacgacccacctgtcataacagcactgctctggacagccgcgcagagatacgagcgctcctcaagcatggttggaatcaaacgaacaagagcgacacagcagtgtattttgacttgaaatcatctactgtagtgcgtcgtttagtacgagagtactcgtattttaagtcgttgtggtaaacgtgattctgttcatgattaaaatgtgatcataacaacttcacatatctgcatcactactatcacccaccactacaatacactatctcagctaataatttattgcctctggggctgtcgaacaaatgctcaatacttttatttttacggaatcatcaggtctaagactacacttagatcttgatgacggcatcgagagccttctgcttcttctcgagcttgtcgagagcctttcggccgagaatacctccgccccactttcgtcgagactcgtcgtacttctcgttgaagttagcctcgatggtggagacgagggtggcaagagtagcctggtcctcggacttgacctcggtaatggcaacgacggcagcggtcttcttgtggacaagagtaccgagtcgggccttacccttgacaatagcgtaagggacacccatctttcggcagagggcagggaggaagacaacgagctcgatggggtcgacatcgttggcaatgaggacgaggttggccttcttgttctcaaccagagagacaacatggttgagaccgtacttcacaacgtagggcttctcggagacgtccttcttgtccttgccggcggcgatagcctcggcctccttggtgagtcgctccttcttctcctccttagtctcgggtcggtacttgttgaggagcttgaaggtctgggcagcggtgttcttgtccagggtgttggagaactgagcgagagaaggaggaaccttgagtcgcatgctcagaatcttcttctgtcgctggagtcgaacgtactcgggccacttgacgaatcgggagaggtttcgcttaggctggatggactgaccaatgccgtaagacttggccttcttctcaaagagagggttcttagcatcctcggtcttggagaccttggcagcagagggggcgggagcaaccttctttcctttagcggcgggctgtgtcattgagtggttaggatttagttcttaaaaaatttgcgaactgctcacatataacactctacagtctcataagagactcagcctggtcccctaggggagcatcagtaacgtcacttcggtaatggagtaacattgtaatcctcctctagcagacagagctgcagagatatctgctcacattcttttcatcatcatcggagccagagctgttcacagctcttctctttggtccttaccatttttgtgtcgggtgttggtagagataagtttcaccaaaaacttcttttcacttgggaggaggagggatgagtggtgtcccaattaggctagggttagccctaagtcgagagtacgtgaattgcaaaacaggaaaccctaacctgccgggagggtgcatcgatcggtgctggtgggtgaccaaacaagtcttagaatgtcaatactgggctaggggccttgcaataggtcacaccacctccagaagtcttctggaccgcttgcttggattatgtctggaggctgttttggcttgcatcagggtaccgtacgtatcttacaagtgtgtggtgtcgtgcagtgatacacatctacatacaagagcgtcttcagttaagacagttgggtggatgtgtatgctgtttttacagcaatctacagtaaagaaccacacaaataaaatgtcacaggtatacagtttcatttgtgattgtttttttaaaaaataagaaaaataagaaaaatcacaggggcatgaaactatatacatgtacgtacctacatactgtattcaagaggtgggaatcccatactgagcccacgttgtgagggcgggacacgctcaagcaaatgacgctgggttactgaataccagatgcgacagtgcgtgtacaagtatcgtaattgtaccggtaggtgaagtgtctgtatcggtatgtacctgaaggctactgttgaaaatggaattcagcactgagtaccgttattttcctgtagtatttacagtaagagcatacttacacaccctacgatatcattactgaagacacagcatttacagaagagcgccagcaggagaagtgatgccgcaaccccctaaatcagcctcattggaaccacaagtacaaccactgaacacaagcatatacaagcacaaatatgaagacattttttagattgtaattatgtggccaatttcatcctccgcgattcaagccgacttcttccacactgaccccagttggttttgcatcttgtccactcaagagtaaaaacttgtatgaggatgcatactacgatacgtacaagtagtacgatagctgtgatgtctgcaagagggctgtaatttctcgagtacgagagactagtgcccagccgttagactcgccgtgaaacgatgatacactccatccactcaacacactccatgcttccagccaccgtacggtttcatttataggctcagtatgtccactgtttcaactcgcgaatgtgatacttgtgcttgtataataatgcaccatgtacgatacgagctctactcaacagtctgtcgggagattacatccttgtactcatacatgccacgagagtttctcgtctaatgacctctaaagtgggagaaaggatcggaatatgtccatcctcagctcttcacccatcgtatccctggagcaatagggttctcggactaagtgagctcgaatgacgtgagtcttccgaatgtatggtgtacaggtagtgcgcgcgtgttggggcagccagggttaggtgcagtctgtaccagctgactttgtactttgagagcaagaacacaggagaatggggtcgcggccaggtaaatgtgccggtttgagggcggaatcggtttcccccaggcgtgcaatcccaattgaacatatcccggtcttcttagccccatcacaagcccctcatttctcatttttgcgtttgtgtcacacatgcgccgacttggggcattactatactttgggccaagtctaaaaccagacactctacgtattccactacacatcacactccgacgcagaatcccccaagcgctgataacctccgttttcgccgccgtttttcgcctccaaaccatccccccacgtccgccacgcccgtcccgacatttgtgtctgtaactacttcccgccacccccaagttacacagaaacaccccaccacaccccccgtgtaactttcgccacgcgttactaaaacatcacctgcacctacaagatgaccgtcaacgagaacgacaacgtgcccgtccagtccaacacccccattgagggcactgatggactgcggcttttcttcggcaacctcgatttccgagtctctgcccctgagctcaaggagtatcttgctgcttacaatgtgtgagtaaacttaatcgcgcgtcgtgcggcgatatcagatggggacaaatggagtacagctggagggctcgaagctgccgtccgtcacgcttctgggatgtccaatactggccgatggcttggtcccccatttttctgcgattttttgtctcccccccccccattgccccccacatttgccactactaaccacagacaacaggtgaccatccccaagcgacgagtcagagccaagaccaccaacaagccctacaagaagggcatgggctacggttttgctcaattcacctccaccgaggacgcgagcaaggctcttgccgagctcacggacgctacctggaacgaccgaaagctcaccgttagtttcgccaaacccaaccagattaagaacgacggcgaggatggtgaggaggaggcctctgccgctgatggtgagaccgctgcccctcccaagaagagcaagcgaaaccgaagatcaaagaaggagaactctgccgaatctggcgatgccacttccaacggaacttcggctgccggcactgaggcttccgagaccaaggaaagcaagccccggggccgacgacctcctcttcctcttaacgaagagtctcccactactgataccgtcttcgttgctggtatcccccgaacggctactgttgctgacatcaaggagttctttgctgccgaggagcccgtgtctgtgaaaatcagccagcagaatgtcttcaaccgaaaggataagacccgagagcgagtcaaccgaggttttgctctagtcaagtttgccgacgaagcaacacgagatgccgtcatcaagaagtaccacgagcaagagtgggatggccgagtgatccacttgcgagtcgcccttgatgttctccagactgagggtgagaccgacaccaaccaggagcccaaggaagaccccaaggaagagcccaaggaggagcccaaggaggagcccaaggaggagcccaaggaggagcccaaggaggagcccaaggaggaggtcaaggaggagcctaaggaggatgctggaaccgaggctcccaccaccaccgaggactcgacccccaaggatgagtaagcatctgcataaatttactaatggttggagtactaattgctaacgtcgctgatggttagaatagtttaaataggaataatcaggttaaaaggtacattacaagtatgcgaaagaatgagttcagtacgcacaagtacatacaatacaagtataatgtacagaagatgtgccattatcgtctgtacagatggtatcggtaaccacatgttggatgcgactgcagggatagcgtgccagttgcatttgcatgttagtggttgtagacggtacgcaataggtcatgtggatgggctgagctcttgttgggcgaactgatccttggtttgtgaccagtgcccgtgaaggctgatatgttaagattgcgttggatcgggctgtttgaagatggattaatcgagtattcaataaatgtctgaacatcctaaatgtacatatattggtactggtacggtacttgtacggtgtactgtgtgtactgtaggtactgtactttacacagtacgtatacccgatctctcaacgccttatccatgagcctaatgaccatgccttgctcacaatataactgcagtcacggtcgctaaaccacaatgatctaagagtgtcaaacaagagcacacagggtaggtacaagttgtgcttcgcaaggtcatttgtttttagaccgtatacgtatgtactgtatcggtaagtactcgtgctcttagacctcaatgtgttcacacgtctgtttggatcacaccactctgtgagttgaccacggatgacggccatataccgatataaaaggtagtggtaaaagatatattaatggacccataactcctcattgattcaaaagatgtcacaacatctcataaacaaataggtctgaacttgctcaccatctcacagctttcagtgtaacgactcctcaacccactgatatagtacgagtagttgtacggggctacaagacctccgccaagataaataactaattatatcttccgtgtaggattcgcatgcttctatcagtgtatctatgtttttggctgtggtactcatatcatccgtcaccatcctcactaccgataaattagggtttgcactctattcgacccatcccccacctctgttagctctcttccaaactttatgtttatcacatgacttactacttttgtgactgcttttcatcccaattgggaactcccaactcactcccggcgtctcggtttaggtatcaagaatttgtcaagtcttcttccccccgactgtataaccgataatcaacaatgggtcgtgtcattcgaaaccaaagaaagggtgctggttctatcttcaccgcccacacccggctccgaaagggcgctgccaagctccgagatctcgactacgccgagcgacacggatacatccgaggtgttgtcaaggagatcatccatgaccccggtcgtggtgctcccctcgccaaggtcgtcttccgagacccctacaagtacaagcagcgagttgagaccttcattgctaacgagggtgtctacactggccagttcatctacgccggtaagaaggctactctgaacgtcggaaacgttctgcccctgggctctgtccccgagggtaccatcctctccaacgtcgaggagcacgccggtgaccgaggtgccattggccgaacttccggtaactacgtcattgtcatcggccacaaccccgatgagggcaagacccgaatcaagcttccttccggatctaagaagattgtcccctctaccgctcgaggtgtcatcggtgttgttgccggtggtggacgaatcgacaagcccctgctcaaggccggccgagccttccacaagtacaaggtcaagcgaaactcttggcccaagactcgaggtgtggctatgaaccccgtcgaccatccccatggtggtggtaaccaccagcatattggtaaggcctctaccatctcccgagaggctgtttctggtcagaaggctggtctcattgctgcccgacgaaccggtctgctccgaggtacccagaagatcaaggagtaaatttaaaaaatgtattattgcaacgagacattcaaacgacgactgtaatcattctaagagagacagcgatacctcaagtaatcaacaagttattaaagagattctgtataggcatgacagtgatggtgggtcaaaattttccaacccattcatgcggtaaaaaattctacttctaagagagtattcgtacagcactgtgcatatcaacaacgattgcaatataaatgatgagaccgaagccacggctttgaatgtgaaagaagttatgtaagtaagacgtacaagtatgtacactgtacctctatctttaacggcggttcgactgttacttatgtttcatagcctctatgaagatctctcctctcttttcatttactgtaatagtgtgcaagtgcaccatggctttttttttttttcatgaagaggcacccataagtgttctacgtctggtccgtgtacatgctgtagttctgtctaaaaaagcgctctacgacaagccgtgtagcctggagtgctttcatggtacatactgtagcacaacgattgatccaagtccgtgttttgtacacaacgggtcagaaataagaccccaagtgttgttttttataatattgcgttcacagactttaaaaaacatactcataaagtcgaaggctttgtttagtgtttgttataggcttatacatacacctcatcaatcgttattcattatcattatatatcgtgtctcataaatgcagcgagatctgactcgctcggcgtggacttggtttgttttacaggtgcacgctgggaatttcccgaataaagccctgtccaaacttggaagaaaagaagatgacggatagaagcatcagatcaaaggctcccagcacaaagaagccagcatgagcccactcgtccgacaaagcaaagccgacctttgtgagaatcagaataccggctcctccaaagagagagtagactccggcaatggaacctcgaatctctgcacgcacgtcggtgcagtagctcatggaggtgatgataactccaatctggccaacaccaatgaagccacagaaaaccatgaaccaggcagtctggggagagtcaatgagacaaagaatccacgaggaaataagaccaaacaaagcagcagcagtgatacagatcgttcgaccaaacttgctgacggcgaagccccagacgggagtagtgagcagagccaccagctgggtgactccggagatgatggaagccataacgtaagcctcctcacatcggtcggttcccttgtaatttctgtcagggccacagtagccgttgttgtggtaccactgattgacaaaggtggggataaagacggccgtggccacagtggtggatcttgcaacaaatccgccggcgtaggcaagcattacagatcgctccttggtcatttccacaaagccctgcttgatgagttctccgtagggaggagtagtcacctgcacggcctgttcttcgggacgctcttcattgttgacagaggcggagatggagaaacctcgctgctgacgaatccagcccttgagactcttgttgggatcctggtaaagagtcaggaaaagaattccggaggcaacaatggcgatagctccaacaatgaaatacgatcgctgcagggcgtctcccttggagaggtctgggaactggctgggaagtcgcaggaagaccagaagcgaaaatacggctcccaggccagttgaaatgccgacaagaacgggaagaatggcctttctcttatcgtggtcggtttcgtagccagcctccggaggatctgagtggaagtggaagccgaagaaggagaaggagatggtggactgggagatttcggagagcatggcggtgatcatggagcccgcagccgaggcaccgacggagaaaagacatcggaaaatgagaatgtccgggtacaacgtctgccgtgttgtatagagcatgatggaggtgccaatgatacacactccgacagatgtgacgattcgggtgccaatcttgtcactgagggctcccagagcaggagcgacgatgatgctgacaatttcgtcggcgacagcgagattgcctacatgggtcgccaccttctttcggtagcccagcaggtcggtgagaatgaagggctgggttgcggacagaaagacgacaaacgcaatggtcaacagacacgagccgtagaaggccgtggtttgtttgaggtggaaaacaccgggttccattttggcagttcacgaagtagcagctgtgtagagagtgtgcagttgagagggttcgggtggtaaaatatagcccgtaccaaacgtaccgatgtactagctgtgcgctaaaccttggaaataaaccctgactgcaggatctgataaatgtgaggggtaagagagagagtacaagtacctgtaacttgagttttgagagtgccgtcagagaaacgagttttgaaattaaacaaataaaacatggggtttctagctgttagtgcttaatattttgttttattcagcaaaaaaatcgtcctccgaggtaaggctctagaacggattacttctgctgtcttggcacaacagggttttcggtttggcagcagtccaatcaaaaagatcatttggaaggtggagccgcagtgctatgtctgggaaaaatacattatcggattgaagtaaacctcttatataagtgacaatagtcggttggagtcaccacctcccccgtttctctccgtataactcaccttacattatcgcgatgatcaaaatagatagtccggtaaacgagcatcatctgataagtccatgtagcacatggcagcgagccaaacaaagaagcagtggcatagagtatttttcacccggagaaaactttttcgactgtgggtaaacaccagttgccggagtgagcctgttgccacacatagcagtgatgtgcctctaactaccaggaccatgtctcaaggctacttactaattacacgtgtcccagtacacgtttcttatacacgtttcaaacaacaatatgtacagtatatactgtacacttcttcctgtctcactcttgtctggcttctctttcctcaccgccgttaaacctaagagacacacaccagccagtaggaaaccaagtagactgtgagacactaagacctgactaattccaattgcattgagtctagagatttgggtgtgttgcgagataacatcttcgtacataagtgttcgctactccgttgtaggtctcatgtatcaaaatgaaattaatggtacagcctctctgtaggtactgggtcctgtatcatttttcattcgtgatgctcagcattagcacttatatgagtgtatgtactgtacagcatggtagacactcgaatacatataaatacattaaaatacaacccacataaatcctacatggcaatgacggacgacgagccctcctggaatcgagccttgaagactcggttggcgttgctgaagaatccctctttaagcgacacaacaatgaactgcgagcccttgaatcgcgtcttgatcagatgaccaatgttctgagtgtggttcaaatccaaagcagcatcaacctcatcaagaatgtacataggagcaggcttgaactggagcagagccagaatcaacgacagagcaactagagatcgctgacctccagaaagctccgccagagactccttccaaatcttacccagcatgaccttgatttccagaccctcggtaatctccttgccctccagaagtaccagcttggcgaaggagccaggcaacagagtcgcgaagatctgaccaaagtcctcgctcaccttcttccacgtcttggtcagagccttgcatttgtactcgttcaaagacacaatggtctgctcaatcttgaccttgtccttctcgatggtcttgatcatacctcgtagagtcgcttccttcttctcaacgttgtcaatcatgttcatgaccttgtcgttgaccttgtgtccgagacccttgattcgctcctccaactggccagcggcccgtcgcacctgcttgatgtccacactctcgtagtcataatgagatccgggcttgccaaacaggtgagcgtcagcagcgacccagttgtacttggcctccatggcagtggcgcccttagaagcatcttccagctccttcatcttacgggtatgaagatgctcagcctcctttgcagcgacaagagcatcggcatggaagtctcgtttctgttgaagagtagcctccaaagatcgtcgctcctcgtccatgccatgcagagcagccatcatctcctcaacctgctgggtcagagaagcctccagagcacgggcctcgtcctgctgagtctccagttgagcaaggccgcctcgggtagcctgaattgcctcttttaaagcctcggcctcgtctttcataccagtaatgtcggacataaactgctcgagagaaacctggatgtcctcatgggcagctgaggcctcgtcaacaacagaccggtgctgagctacttcagcagccatttcttcgacagaagcagccagctcctcaagcttactgcccttgttctttccaaagtcagccatgtctctctcaatagttccaatcagagcaatggcgtcttcaagcttctggttgagcgtgggaagggactcctggagctcatgaagctcggcctcctgttcctgcttctttcgcagaacagaagcactggaagaagactccagttgcttctcgccggtcttgatctcgtgctcccgaattgaaagctggttttcaagctgtcgtcgctcagagataactttggaaaactgagccatggacttctggatgttgctgagatcgtatcgagcctcctccagctcctgtgtaaggttgttgatgctcgtcaacttcttgagaagatctccacttcgctgctgagagcctccagaaagggtaccctcaggcgagtagtgatctccctccagagtcacacaatgagcacgaatctggggatggtaagcacacttctttgcggtctcggtatctacacacacaagagtgccgccaaaaacataagccatggccttagcaacctcatcggagtatccaactagctctagggcacgtccaacccggccgggggccacctgctgggccacggcgagtcgctccgcagaaattagaccttcggcagcaattttattcagaggaatcatggtgactcgtcgcttgagtcggccccgctgtagcagctccttaccggtgatctcattgtcaacaacaacgttgaacagcttgcctccagcagcaacctgcagagcaatgcacttgtccatgttctcatctccaatggtcagcagttcggccacgaaacccttgacggatgaagcagagaagttggcatgaggacgagcgtaggtgaactcggagaacgacgcttgacgcttctcggagtcaattcgagcagaaagagcatcgattcgcgacatgcactcgcgctcctttccggtccagtcctcgtcggctccgggaacagccataagacgctccacttcagcttccagagctcctttggcttctcgcagaccagccagcttgtcgagcacgctctggttctggctctcagccttggcgaccttgggagcgtctcttttgagagcctctgtcagatgtgagattcgcatctgagcacgatcaattgccacacgagaatcattggcctgttcacgtgcctcagcaagttggcgctggtagccagactccttaccggccgaagatgcgataccggtctgaagcgactgtagcagttcacgcttggactcgagagccttggtcatggagtcaagacgctgtgtttgagcgtccagttctctctggctagcgtcaacttcggcctggcgcttctggagctcctcggttcgatcagtagcctcaagactggctagtgaatcttcttcctcggtaagctgggaccgtttcaggtcgattgtagtgttgagacgcaccacttcatgggaggcagccttggcctgcttttgaagaacagaaacattcgtatctttagacgcctcggctgcctgacgagccttgacctcggcaatgtcctgctcgagcacgcccatctcgtgtgtgttctgctccactgctagggcctttgcttccttctcggcaacaatcgcttcaatagcggcggtcatctcctgagcaccctgggtcaacatgatgtagtcatgtgccacaatgagcttgatagcccgctcgaggtcggactgggtgtgttggtactcgaggaacgacttcttttcctgtcgcagcttatccaacttgggcttaatttcctcctccaaaagcaatgcactttcctggcgccgggcatccttcttcgccatagtcttgagagccttctcctttcgatcctcgtacattcgagttccagcggcctcctcgatgagagccagcacctcggcaggcttcatgttcagtactttggtgattcgaccctgcatgatcagaaagttgggattgttgatattgagctggaccgattggaacaaatgctgtaccgtctgctgctgcgctcggtgaccgttgatcaggtacttgctcgtgcctccaagcacaatttgacgggtcaccgagatctgggcgtacttctcgaacccgataggactagtggcggtatctgagttgtcgaaaacaatggtgacacttgccttggtcacaccggcctgtcctcgcttgtagatgagatcctggaggttctgagctcgaacagtagccatggtcgtgatacctagcacgaaacaaatggcgtccagaatgttggacttgccactaccgttgagaccggtgatacagttgaactgcgggtcccatccggagatgactgtacgcgtggcgtacgacttgaagccgtcgattacgagctcttcgactttcatttaggtgttgagaggtgtggtttagaaaaagaacgttaagcgtgtttcgtgtttgggacctgttgtcccagcaacggttagagttttgagtgttacactttaattcgccgcgaaagctactcgtaagtagttgaagtactgattataggtgcgttctgttaccaaaaacaatggctacacattacaagtagtcggttccattgcagcaaaaaatgacaaccgagagattcgaactctcgcctccgaagagaccaggatattcgttaaggtgttagccttaacctggcgccttagaccgctcggccaggttgcccgaaatgtgccagattcgggtccgtttcttattccaaaagtggttcgggtcacgtgattactgtactgtaatgaatctgtaatgaatcattagaataaaaataaaaaaccgtgtttcactagaataaacaaaattcctagttgattttcagaacgtcttaccaagtggcaagtgtgtgttctattgttctttactaaatggcatggaaagtatcgcatcactgctgtatgatgggctcagagctgttctcctgatgcttgagggaaaaaaacagaaaagaagaagaagaaaaaaatcatttgacgatgaagatcgatggggcgttgtttttggagcccctgtggagcttcttctttacttttttatttttatttaaccaggggcctgtgggcaggtgttggatgttgtgcttgtttaccacatcttgatttggagttgtataggaagtctaactcacgcgacaagtacttacacaattgtgtgtgacaagaaatatacagtacattttacacgtgtaagtgcccgatattcattccaaactacagcaagggcgtagaaactccttaacaccaaaatcgaacgccattttttttttattctaattacaaaaatcaaacgttttttttcttttctaatgattcgtgactaagcagaaagcacaatgtttgcctaacgttttcaaaaatcggaagatttttcaggcatcctggccgagcggttaaggcgagagattagaaatctcttggggtttccccgcgtaggttcgaatcctgcggatgtcgccattttttgttgatcctgaacagatacgaaccgacacttactttaactcgtacccttagaatatgcgtactgtacttggattcgtgtcctcgagtcatgtctcaatctcattttaagtagctacgattacttatctcgtcgctccatttttgaaatgcaataattatacaagtaaacaggaacagtaaacagatactagcggaaacctccaagagtctttcttcgcttggaacgcttctgagaaccgccctgtgaaccggaggggccagcagattgtcttctcgtgtcctgagaggcaacacgagctagcgacgagcgatgggagctggacggagccaaagatgctcgctgcgaaggagcctggctcgagagagacagtgtgggaatcgtgtttctgctggcaacaatctgggaaagcagctcctgctgagtaggggccttacgcttattcttgcgcgttccaaattcgacccaatcatcgtagttggttttgggaggcgcacctatcacccagtcatccaacatctttgtaatatgcaccggaacgtccttttcctttcctctgtcttctttggagcgacgtacgctacacgtcaggtagcagagcgtagctgccaaccgacgacacatacgctcagtcttgatgcgatactctatgaggtactttccaagaagaggattgccccgatcagatgtgtcagtcgagggagtgacgtatacactcatgagttcctcgtactttttcactgggtccacatttgggaagatccggaccgcagaggtgctataatgtttctgcaactcgcccagcatctccccaaactcatcaatcgacgaaggtgtgtcgtcagctcccaattgagctagagacgttctaccgccaggacagccttccttgtgccaggtcttgatgagaccatcaagcttcccagcaatctcagacacaccaatgggctctggaaatggtggcggtagcataaactcgtcatagccttcaaaactgaacactctcacgttttgttctttaccatttttgtactgaccaggaaacttccacactgggtcaggtttgtagtcttgaaatttggacggttcactagtgagaagcttgcgaactacacatccatcaatgtcgcaatcgaacagcatgtcaatagcgcctgggaactcaaccagcagggttgaattgataggtgtttgtgtagacagcataatagggtaagggtcacaggtccattctagcagaagtggctctgcagggttctggtatgcatatgtgtagaatatcttctgaagagacaattgagaatggacaatggcaattgacttgccttcgaccagggacatggagagcttgatggaggcatcctcactcagcaggttcattgttcgggagatctgaagaggcgtatctttgttaaggtcaaagatcatcattcgcaccgcagaaagcacaactagcaagttagggtacttggggtctcttttcatgtccataatcacgtcgcctgcatgctgctgttgaaacaactcgacaaaagtcggttcagctcccatatcctccttgttcatcgcatatagccgcagtcctttccttgaagccagggccatcttcttgcctccatcaaacagcttgatacttttccagtcactaagcacctcaaagcgtggatcgtatccctgagcaataattggaggatgagcttccggctctgttcccaactggtgtattcgccatgttccatctgcagttgctcctgcgtataggtcgccctgaagatcacagtccacgtacttgtcgtctctgagatcaaagtaggacgtggaaaccatgcttgtaaacagctcttggacattagcatttaggtccacaacatgagtagctcctgtagttcgtaccaaaagtcgcgtagcaagtttacccgttcccgcagggttgtcaaacagcacctgggtgatttcgcgcttgaaatcgtgctgcttgacatgatgtaggcttgggagtgacttgtcaaacacatcacgggtggtggcatacgccggatcaagagatgggtcttgaggagcaacgttctctatgatcagctcattccccttggcatgagccataattctgaaagtggcgaaattcgtgtcctcgacatgctcagtatctccatggttccattccacgtcggccatggccatctttgttcccacatcgaccctaaacagcatgctggacttgcgaaagcccaactctcggtcttcagcgaacttggcatgcatctcggccaaagggattttacttttgttcacggcttgattacgaaccgtctcgacgatatctccctctgtagagctggtgaaggtccggaacccggtgtcgtagagggtcaaggactggccgacctccgatagaggcagactgctgttgacagtggggtaatgcaagtcggtgtcgccaaagacctctcgggagatgagaggcatgccccattgaccggtgccgacctgggactcccacaaggacgggtctgtgttcacccagctcacttggctcacttgttcgctcatttcgcgtgttgcagtgaaatgcttctgcacgccaacatctagcttcaaataatttggacttgcagaaagtgtaatcaatgcagagtgtagtgcctacttgtagctacagtaagtacttttacagtaggcacttgccaataactacaagagcaaaagtaccaagctacatgtgacgagacagaacgagacttgtagaacgcctttgtacttgtgcctcatctataccgttagtcgtaagggaatacatggcacaggctgattaaacatgagtcgtaatctacaaagatccagactgtgcagtgtcataaccgtagcaaacctgctaggcaccgcaattactagtagagcatgtgtaaaaatctttcttgaaaggcaggaacctctacgtacgtaaagatcaattgtatggtacgtgcaccattcaatttgtcctacggtaatagctacagtatgtacttgtagctagctagctgcaaagaacgacacaaagctcacacctcaccttcatattcctactacatactgtagctagcacatcacgcaacaataactactggtcggagacgttcggactaggtcttctgttctccttctcttattcacacaaactcaagaactatgtaactaaatacaacgattcgagtatttcagcggactcatgtgtagcactttggatcagtctataactaaccaaaggcacacgcgtggtggttagccacgctcgcatctattactcaaatcgcaggtcccagtcaatcttgggaccgagcttgggcagctgctcagcaacgttctgcacgtccttgtctcctcgtccagagagacagatgaccacgttcttgtccttgggcagcttcttggccagctccatggcaccgtggatggcgtgcgacgactcaagggcgggaatgataccctccagctgggtcagctgtcggaaggcgttgagagcgtcggcatcggaggcagcaacaaactcaactcggccagtatccttccagtaggacagctcaggaccgacaccggggtagtccagaccagcggagatagagtgtgtgtcctggatctgaccatcggcgttctgcagaacgtaggtcttgactccctggaacactccgacctggcccttagtgagggtagcagagtgggcgggtgtatcaataccgtctcctccagcctcgacaccaacaagtcgcacagacttgtcgttctcgaagggagcaaacataccggaggagttggatccaccgccgacacaggcgacaacggcatcaggcagagcaccgttgttgagggcagcaaactgctccttggtctctcggccaataacggactgaagagttcgcaccagagtggggtaggggtgagggccaatggcagaaccaatgacgtagtgggttgactcgaggttggtgacccagaatcgcagagcctcgttgacggcgtctcgcagagtcttggagccctcctcgaccttgacaacctcggcaccaagcattcgcatacggaacacgttgagagactgtcgtcgggcgtcctcagcacccataaagaccttgcacttcatgccgaacttggcggcaacagtggcggtagcaacaccgtgctggccggctccggtctcggcaatgagctctttcttgcccaatcgcttggcaagaatgacctgaccgacggcattgttgatcttgtgagaaccggtgtggttgaggtcctctcgcttgagccagatcttggctcctccgcagtgctcggtgagtcgctcggcctcatggaaggaggagggtcggttcatgtaggcaaagtaggatcggaactcctcccagaaagattcatcagcaaaggcctcctcgacgcaagtctcgagctccagcagacatcggtgcagagactcgggtacgtactggcctccgtgaacaccgaatcgggcagggtagacagactttcgcagcacctcgtcggtgttgacggcctgggtagtgtcggacttgttttcgttggacacagcggcagaggctgctcgtccaccagtcacagactgcaggtacttggcgacagcctcgggggatccgttggactcctcgatggtggcaatgatcttggatccaatgacaataccgtcggccaggggggccagctggttgaagtgctcctgggtggacactccaaagccaactgccagaggcttgcctccagtgtactttcggaccttagccacgagctcgtcaatgtcggtagacagcttgccggtggcgccagtgacgcccattcgcgagacgacgtacatgaaagagtcggtgatggaagcgaggacctcaagacggtcgttgggggtggtgggggcgaccagagggacgtaagacagaccctcacgagtgcagaggcctctgaaagcaacagcctcctccgggggaaggtcgacgataatgaaaccgttggctccagcgtctcgggcagccttgacaaacttctcgtcaccaaaatggtggatagggttgtagtagcccatgagcacaatggggacgtggacgcccttggctcgagcctgcttgacaaggtccagacacgagtggacggtgacaccgttggcaagagccacattgttggcggcctggatggcagggccgtcggcaacagggtcggtgaaggggatgccgagctcaatcacgtcggctcctccggtctggaggccctcgagaatgggcacggttttttcaacagaggggaatcctgcggtgacgaaggtaacgagggcgggacggccctccttcttgcactgctcgaaagtggcagccagatgagcagacattttgtagcggtgtagtgtgcgtgtggagtataagagaggtttgatctggtattgaaattggtgaaattcttagactcggaggttaggggaggatataaaggctgatttaggcgctagtttgtatgatactgtttctgggaaagcagatggatcgattttaagtggtcgaaataatatactgatgggaattataccaatttaagccactgaaatactccttatgactcttgcacgaaatgttgtgccccggatattcaccgcttttagagttgccggctgggtcagtcataaaccctgtttgtcaccttctgaactgctctcgtaactgtaggttgagttcgtgtattcagttatgaaagttactgtagctgctagcagagctttcaaggaggtaccaatgttgataagcacgtgtattatacgagtagatcatgatgaagtcagtctgttacaatacaccactccatctgggtactgtaattataaaagatgcaccaaaagcatggtgtacttgcgcacctcatagcactgtctgacgtgcatcggcaactctctatacagtatgtaccaggctgcggctgatcctctccgaagacagagccattgggtgacagaaggtgactaatatcatacccctggtagtgatctggcggcgtaggagttaactgttgacaattatgggagacatcaagcgcttgcttgctcaaacaagtctccagtgacgtgtattgcacccctatcttgtgcatatgctgaactagtcctgccagtcacgcttaccatattgctccgataacggcgtgcatgtggggtacacaatggggttgaatgaccgctgaatggagtaattgttggtattctgagatgccacatacaagccgtgatggttgaataataataatataattaagtattggatggtagtttttcttttatgtagccaggcaaaattttcttagctataaatcgtggttgttgtagcccacatcgttataaatgaactacagtatactttgcacagtcgatacccgagcttactaagtataataagatatatggccgaattatttccctgttgttgcctatactaaaagagggagatagatggaaacatagtcactgggttgagcagctgaaacaattttaccgcggtaatgtaagtcataacctgtaccaaataccctaggcgtaaaaagaagcacgcaaaagatgcatgtttaccctaccgcgacaagctggtttatatagagcggataggcccaattttttccgcatcacagccaaaaagagtgagtatcgacaacagcacgaggcttcaaaggatgaacgtatcacagacctgtaccgatctcgggggttgtatcccaggaacagaggaaatgattgcctaacgctgacacaaatgagaaatttgtatttcccatgagactttgaactaacatagatgagtgatacttcagtaaagtcaactaagacaccactatatagttaactatttattaattatcctaccaagaaaacatagctactatatgagtcttgtgcatttttgagcttggagaatcacatatacacggtatacgccacgaaaatcgattggatctctctgaatagttaacgcccaaagttgctcgcctccttcgtattaataacactattggtgcattacgtcacaaaccatccctgcagatgttgggcggtgatatactgggggctatagtgtagaaggcagattaataaccatggaaatcaagtaaaagtgctcatataaacaacatcatctgcccttaatttattccttctcttctggaacaccttcctacatccacctccaattccccaacacgtgacttatctcgcatagcgcgcatcagtccatcggcgctcaacactactgtagtctttgcaaccccacaacaccatggaatcggtattcagaatcattctgtttatcatgctcatggggctgctcatgtcgccggggggcaaccgctacacgcccctcagccgcaaggagaaacgccaacttgagcaacttgttgccaaccacaagttccaggcagaccggctccgaaaccacaacgctcacgactacacctttggcaacctgacggggttcacgtttggttatacaaagccgcgcaagggagacaaacgacaacagctgggctgtcgcgacgagggagacaaggtgtcgctattcccacaggacgttctcaacgaggccagctcatattggaaaaacgaaaagggactgtatctgcgcaacatttctggcgttgtgcggggcgactggacaggtcccgcgaacgacacacagaaacttctccacatccccatgccagtgtcgcaacaaaattggacgtggcatcctcacaaccacagcgttagcatcactcctctaccaatagaccccgatgacgacggtggcgacgagggagaacagcggataaatggcaacatcacagccgttgacggtaaagttgaactcgacttcattgatgccatccccagctacgttaatcagcgcattcttagctcatactttgctaaccacactgtgccaaaggagctggaagcgtttgcagatgtgaacgtggtcacgtgtacagcccagctaatgggccaggagtccgactcagaactccacacggtagtgctccggggcttgcatttcaagcactccggaaacgtcatcatgacaacccactcagcaaagttctgggggtacgaggctctagcgggcatgctagcggaaatcatgcaaacggccgaccgatcacgtgaaagtaccgacgatgccttcaacactaccaaggaggccatgatgcccatcattgagcggcacctgtcgattattggagacacagatcaggctgttcctgtgtcggaaatggagcaggaggccgctgcgtcgtgcgagtacattggtgttttgcacgtagattccgtcgatgctaatcaatacagcggaatagacctccgaaacattgagtcagagcttcaatacccagtggggcgtcctcacaagcgacccccaagactccaaatgagcggagtgttgtactcgcctgattgcggcaagaaaatgaccgttggagacgcaaagggcctactttggaatgcctctttgatgaaacagaaccatgtggtcgtggctgtcatcttccttggaatcatcaacactctgctgctggcattccagatgcaaaaggcgtcgaccccttctctgtgctctcgggtcagcatctggtcgattggagttatgtccatgatggacggattcatgtgcatgttttcgctcatggccattctttaccgaacccagccccagttgcagttcacggctcttgcatttgtgtctttcacctacgtatcgctgtttggactgcggttcatgctcaacatcactctgtcgcagatacccgaggaatttgcgcgtcctgctgccatccagactcctggaggaaacgcgcaagacaatacccctggtggggatgacactcttccagtgacagaaacacagcctgcagccaccccattcattccgtccgacgcagacgtttccacagcactctatggacgattttacttctgtctgctagcgtttgtcatcgttactacagtaacctatggaatgactgctcctcgacgatacgtgatggagtacgtgattgttctgggtatggcgtcgctatggctgcctcaaatctacagaactgcataccgaggcactcagcaggctccgttggcgtggtactttatgattggcagttcctttacgcgtctgctacctctctactacgtgtgcctggttaaggacgatgttttcagacaccgaattgaccggattctgccaacattggctactctatggattgctcttcagctgtttgtcatttacgcccagcacaagtttggtcctcggttcatcttgccgcagcacatcctgccccccatctacgactaccatcctatcatcagccaggatgacattgagagcggcagttacggtgcgttgtttgaaaacgccgccaatggatcattagaagacgcacacactgactgcagcatctgcatgaaccccgtcgagcttgtggtgcagacgtcggacgagcagaacaacatggacccagcgaagctcgtggctagacgacaatacatgatcacgccgtgccgccatgtgttccatacggactgtatgagcaactggatgatccgaaaactacagtgtcctgtttgtcgaaatcctcttcctcccatgtgaggtgtgatactgtgatactgtgatatgacagcatatatatattcgtaacatagatgtttatttaatagtgggaggtgcaccagtagcagatttggtattagaatgaagggagtatggtctgtatagggtacaattcagagatacttactggtgacctgtgtagtaatcgttaatatcattcagttttaattatatatactggtacttgtaccacccatctactgagacttaatccactgctcagcaaagtcagtgacactcttctgaagagggatccacttaattcctagcaatttatccgtctcggagcagtcgagctgacaaacagttttgagctccttatctcggttggcagggtttccggtggcgatattaccctccagctgggggatcttgttggcaatatcttcgatgtcttgggtgcagaaagcactggtgcccagaagcagtctccttcggtcaagctcgggcttgagagcaataacgtgagcctcagcgcagtctcggacgtcgacgaaccagcccgcagagccctcagggttctggcccttcttggactgaagaacagcagcaatcagctcgtttgaggtgttgagagcagacatgtccagggcaataccgggaccgaagatataggaggggttgatccaggtgatggagaagtgaggtttctcgttgttcaggaattccagacctgccttctcggcatacagcttggatcccacgtagttggcaaaggggttgcctttctcagccgcctgctctcgggtcattgggttccagtccttctcagtcagagtgtgagtagggtcattgtacttggacacgtccatgatggcggccaaagaagaggtgatgacaatcttcttcacattgggagcatgagtcttggccattttcagaacagcagtggttcctttgacggcaggctgaagcatatctttctcggggtcctcagccttcatgttaaaaggcgaggccgtgtgcagaatgtagtcaatctcagggtgcttctcgaagatgacctggaactcgacctcatcctggacgtccttgagtgtctcaagctcgaacttgccggactcgacctcgttcttaaaggcctccgcaagtcgctcggccttctgggggcttcgaatagttccgatgacggtatgaccagccttgagcagttggtcaacacaatgacctgccagaaagccggtagctccagtaacaagggtggtaggcatagttgtagatatggtagatgccagtgatataatgcctatcaaggcccaccccatcccttaaatatatccatgtttgctgcttcaaagcccattaagtttatcaggcggcttgaagatagctcaccttaggcggacagttggaggcgcgtaccggtacttgtagggcgaaagggatgttagaaggacaaagggaaaggattgcgacccaataacccaccgtccgacaccccttttggccattttactgccaaaaaatcttcgcaatttccccaattgtcattgttgtcctgattcctgctcgcacaaacttcacaacctcacgccatgcatgctagcaaagtccgtcgataacggagatacacacccaggaaattatgtccgtggtcagtgaagttaacagtattagagtggatttgtcatgacagagaatttcaactcaaatgatcactaaggagggcatcacgtggcttgggtggttcgatagcggaagctggagccattgtaacaatcgctcaagtatcagtctaaatagctgtgagctaagtaatgccaactaccataagaggtgcatgccacccagttctcgaaacaagtaccatactgcatgttgattcgtattcgctgcctacaattctgatcataagtgctccgagagaataatatttgttcaattgtcgcctcgagccacgcctgtgttctacagtacgagtattgcagcttgtgtctgactaactgtattatcagaagacagttaaggacaacacaattcactcaggagcaagttgggacagcacaaagcctcttcttgtagctacaatatatacagtaattacgacaccgtaggggcgtccatgcacctgaacaaattaatatagagataaatctgcaaagcgctattacacagatcgtcaagacctccaagagagtgtgccaaagagtcatataggaaaggtcgttttgcctccatttgcgacaagttgtgtagcccaccggacagttgattttaaatattttcacccagtaaacacggtcacgaagaactcaccaaatgatgattctaaaccaagaccaaaccaactaattcccattatcacaaaacctttccgtagataccccaaccaatacacaggcgacagacaacaacaagtactactatctacaacgtacaaacacctgcggtatttgaacccatctcagttcattttcacgtgcaataatacattttagttttgtgtctacttcttggagacaatcttcttgaggtagaaagcaagctcctctccctcgagaacgtaaccgtcaactcggccggactgaccgggtcgagaagaaacgcaggcgtagagtcggccagcaccgaactgagcctcgacggcggggtcgagcttggcatcagcctgtcgggcagcaacggcagcctggtcagcctcagcaatgacgggctcctcctggccagccttcttcttgccgagagacttgccgtagtaggactcgtaccactgtcggaaaggagtggcatcaatctggacaatggcagacttggtcagagtgttggttcggataagctcgttgttggaggggtggaaagagacaccgaggactcgggtctttcgggtggttccctcagagccccaggagaagttgccggtctcgattcggatggctcggaacttcttgttaccaccacgggttcggacggtgtggattcgcttggggccgattcgggtgacggcaccctgtcgaccgcactcgaactttcgcttcttgtggatggagacacgcttggcgccggtgtgggatcgcttgtgtcgggagtctcgagaaatacccatggttgtcgtggagtgctgagaattggtgggaggtttgattttttgtcagaggtgggagcagagtttccgagtttccttttcagaaagcagtcacaaagtcacgtgtgactcagagttaatttggacgtttgagtattagggttcaaattgtcgtgtgttcgaatctgggagacggcgcacttaataggtgaaattggatgagcagatgtttttaaaacgacgtgagggcatccgtggttcgatgctatgtacacactacaaatacgtcaacacacaaataacagccgtctccaccactagacgtcgatgattctatgatcgtcgccccccaccccttgacaccaccacatcctcgttggtttcctttttttcgtctctataaacctgccaggccccaaaatcatgtacataaatactcaaaatatcaatctatctacccaccactactacttatttgtaccgtcttatatctcaactatctaatatatctgatcgatctaataccttccgcgagtatctcatctcgtagtaagccccctataaccctaacccaacaccctctttacgtgtaatcgtgcttctgacatgcgcaatttgaaattttcgaacagatgtcttcagctacccctgtggcgttcgttacttgcaccccatgtctttctacgacgaaatcgaaatcgaagacatgatcttcgacgcggatcagggtatcttaacgtatccttgtccgtgtggcgacaagttccagattgccctggacgacctcaaggatggcgaagaggtagccgtctgtccctcgtgcagtctcatgatcaaggtcattttcgaccccgaggaccttgagcagtttgaagaatcgtgacgaagaggtgctctatagcactagtcaaaattcagattatgactggaaactgtcatacacgacaccctcactatgaactgttctgtcacgacttctacgacatatgccatgggccccctccacacactctcaaacacacacacacacacacacacacacacacacacacacacaccatacacatacatacattcaggtcacgcggactactcacatatccgtgtgacaaggtaagaagcaatcgttgtgtcttggtccacatatctatttattcactaatggaaaaagaagcaaacatgcaactctagttagcacggcgtccatgtatttatctgtatttgttcctcacactcgattgggaatagctacaagtactcgtcttatagttgaattcacgcgaccgtaaggttgaagaagaaaataggatggataggacgatgacatcactttacttgttcccttgccatgctggcagctgtatagtaagcgccactaggtgtctgtgcctatcagctacctagatcttccttgcttatagaagtgtacagatacttctcttcgaacttgttctgcgcagatcaccttccgttatcaggaatacgatttaggacgctcacaattacgattcagcgtctctcggagcttcgaggcatttgtctagcgacaaggtccactacagagagggtatacaagtgagttatttgtcgacgaaaactacagagagaagctataacgccaattataccatgtcgtggctccgaacatctcaccgagcgcattctcctattctgttaccctcattaaaccagccgcagccgttggtgagccgttcggagataaccttgagagagaggacgatgtacaagtcaagtagagggtgggggaagagttgataattgagttgtttatagcttctggaaggcagagtcacactacggtgtatgcaccgctatgggtcacccgatctcacgcaccaggtatgtacagtacgatactctcccgtcttcgctagcatctcgctcttgagacgtccagacacgcatcccgaggcaatccctaatagagctcaactgtctgagagctgaagtttgacgtcaatcgggtggagacatactcaatatacaagtactggcataggctgagatggaaaaatgaacgttctgagaggctactactgctcaacttcggtttgtgtcacctcaaacatttgtactacggcctacagaggcctattccgcacgataagtgaaactaaaaagagatgctagagcacggtgccaagctaaggaacgtgccaggagttagaggcggtccaagggctgtggtaagaagctggaaatcgagacacagctcatatatcactcacagacgccaatatccccacctggccccccgctccaacagcagagatatctcgggtttcttaactccgaatttaaaccctgatgaaatccaaatgcgacatttctgcaaaccggctgcaggggaatacaagcagttataagaccgcctggtggccctagccgatctcctttcgagcaaaaaaaaacatcgcgtaaccccgatcacccgcaccaacagcaccaaccacagaaaccgcacacaaacacaacaagatggaaaccctagcaaattggcttctacccgacacccccaagcctctggacatcaagcaactgacttttggccgacctgggggaaacaagggcttcaccttctccaccatccctctgcccctcaagaccaatgaggtacttattgaggtgaaggcggcctcactcaatccatgggacctcaaggtgtggaagcagccccagacttggctcaaggaagagcatggcttgggccaggatttctccggtatcatcagcgatctgggccagggagctgcgtcaaagggctggaaggttggcgatcgtgtctgtggtctcaaacttcactacggtagtcagggaaccattgcgtcccacattgttattgacctcaacaagaccaagtactctatgacccacattcccgacaacatgactttcgaggaggccgcagcgttcccactcgtgtttggagccgcctgggagggcctgtcacattgcccaatgcaggcgattagagatcagaccctcaacgtctgtattctgggaggaggaacagccgtgggccagatggccatccagctggccaagaaccacctgcgagccaagcacgtggtgtgcaccacagccggcggcgagtcggaggagattgcacgtgatctcggtgcagaccatgttatcgattacaaggctgccggaaacgtcggagacgccattgagtacattgtcggcaaccaggagctagacgataccaacgaccagcacagggtgcggtttgcaaactcgtactccactaatggcgagaaatttgacgtgatcctcgactgcgccggaggtgctggagctggagacgtgctggcgaaggccaagtcgcttctcaagccctacaatgagggatccgcctttgtcacccttgtgggagactacaatacccccaaggtcaatgcctcggttgtccacggctccaatggtccctctcctctcatttccaagtccatctccacatatgactccgcttcatattggtacggaggctggactcataagctggctttccagaccggctcttcaggttttagatacatcaccgccaatgtcaagggctctggtgactggatcaaccaagcccacgctggcttcgcatccaactctatcaaggtgcgaattgacacggtatacccctggaccaagtacgacgacgcctttgagcagctcctgagccgaaaggtcaagggcaaaattgttctgcgaatccaggacttttaatgggataatggtaatatataataatataatggatgtgcatatggtgattcgggtgaagcagggatatggtagcgagtccttgtacaatcgttgtgtacttgtaggtactgtagctggtatttattggcatgtgttatatccacatgttagtctctcttgatgcaagtacttatatgcatatgcatcccctgcatggataaacttcaccattgccaagctcggttaacatctttcatatcagcaacaatgaccatgaagtgagtaccgaacgacaatggccatgaaagagcttcgattaacacagcatccgcgcttgcctcttcgacatggatggtctactcatcaactctgagcagatctacaccgatgttgccaacgagattttagccgaacacggtaaaggtcctcttccctgggagatcaagaaggacctgcagggccgacctggtcctgaggccgcgcgagtcttccttgaatggtctggattgccctacaaccccgacgagtattacgccatgacctctgctcgtcagtcggaaaagtggcagacctgcaagttcatgcccggagctctggagctgctgaagtacctcaaggagaaggacattccttttgctctggccacctcatcccaccgaggaaactttgagaagaagaccgcccacctgggtcacggattcgagctctttggcgaccacattgtcgttggagatgacgagcgaatccccaagggtcgtggcaagcccaaccccgacatctggcaagtggctctcaagtctctgaacgaccagagacacgccggtgaccagatcaagcccaatgaggtgctggtgttcgaggacggcattcccggcgttgtttccggacgagctgctgaggcccatgttatttgggtgcccgatcagcgccttctcaacgtgctcaagaagggcgaggcccaggagatcattggcaaccaaggcgagattctcacctctctcgccgatctcgacaagaccaagtatggcctttaattggatctatgtaaatcaacatcaatacgctttaggcaagcttttaaatcagacatgaaccatactgtacctctagatcagcatgaagcatagaccaccctaactcattgttgcaagaccactaaactaatagctgtatttgtgccgcccggcccctcactcactcttctataaatacattctctacaaaggaacgtttctaaacaaatagctgacggactctccgttgtgaagacgtcggatactctctgccagcacgccggaaatgtcaatgatgccgagcttgggacactggtccattttggtttgcagatccagagtgttggtgcacacgactcggtcgagcttggagttgttgatgatctcaatggctcggccagacagaatgccgtgggtgacaatggcaatcaccttgatagcgccgtgctcaaatagagtatcggcagccttggccagagtaccacaagtatcggccatatcgtcgacaagcacacacaccttatccttgacgtctccaaccagcaccatacggctgacctcgttagctcgagcccgctccttgtggatcagagcaaagttgagatccagacggtcggcaagagcagcggctcgcttggctccaccggcatccggcgacacaatgatggtgtttgtgtggtctccgggctggccattgacgttatgcatgatctcggacttgaggtagttgaccaccgagggctcggcgtagaggttatccacaggtacgtcgaagaagccctggatctgagaagcatgcaggtccatggtgatgacatggttgcatccagcagtctgaagcatgttggccatgagcttggcggtgatgggggctcgagacttgtcctttcggtcctgacgcgcgtaggcaaagttggggagaacagcggtgattcgccgggccgaggcggtcttgcaggcgttgatcatgattagcatctccaagatacggtcattgacctcgccgcagcccacctggcagatgatgtacacatcctcgtctcgaaccgactctccaatggtgatggaagtttctcggttggagtctcggaaaatgttgattttggccagggggaggccgagtctgggttagcacaaggaagtgagtggctgtaggtcacggacgctcaacgatctatgccaggtcagaagagaataacggagagccatgcaagaggaacaagacgcatgattctgaaacagatacagtaattcgcaatcggaggacaagggtgcagcaaacagattgccgtcacatgaacactgaacttcacctgtccacgaggccaaagaactgcttatattcacatgctccccatatgtcgttctcggtgaccgtatagattagtccgcaaccgttcaataatgaaagcgggaatcgataaaacctgtcttctgtgtcgctttgcatcttctggtgtgtcggtgtctctcctcttctgtcttgtgacttgagtaacactgtcgttgtcggagctcaccggctgactcatcccgtcttctcggcacaaactcacctagcagcaactttctcagccaagccctggttgatatcaccggacagaatcttgatggagttggaagtcatggttgcactggccgttaaggacaaactcgaaatatggagacgggctgctgctgttcatcaatcatttttttagggttagagttggtctctcacgtgctgcggaggacaccgaatctccagacgtggggcaccaagggcctgcaattggctatcatcagggtaatcacagttgtgtaccaggctggggctgctgaaaaatgccggttacaaaacgttcttatatactgttcgtctctggatcccatatagacccaccacacgtaccatgcaatcgtaagccaaaccggcgtctcagatgcggatcgaacccccgtctgacaagtgcactccaaaaatccacaatagctgataggcctgaaaagtaagtcttttgacggagtccgaaaagggcagtttgagacgtttccgaccaaataaaccgaccaggagatatatggactctggatcgactgcagaaaatgtctctcaaatggccccttttcacggatctatatctatactggagatatgtgcgctagttgagtctattgagcgagcccgagtcaagcagacggtcaagagtcaaaataatgactggtatatataaatactatgtacaatataaatatggattgtggtggagtaccggggcttttagacaatcactccgcagcccaaaacccgatcctcgtggtacaacacgaggttttgaccaggactaaccgcccgaactggcacggctgtcctaattgcaatgtcctctccttcaatagccaaatttgtaatggccacgggctccatgagagatcggaattgaatggtgagattcattccgctcaaatcggctggcttggtacccagccaggaaaagtacttagccttgatgttcgagctaaagaggctgggatggtttcctcccttgacaataaccagttcattggtgtcaatgttcttttccttgacgaaccacgaaccacggtacttggggttgccctggggaaggcagattccagacttctggcccacagtagcattccatagtccgttatgctgaccgaccacttctccctcctcagtaatcacattaccaggagtagtggaaatgtaatcgcttagaaagtcgcgaaacttgcgctggtcctgagacacaaaacacagtccctgagagtcaggtttggacgccacgtgaagtttgtaggcgtgggccatctctctgatctccggcttgagatagtcagatagggggaacatgacgtttctgagcgagtcggagttcactgaagaaagataataactctgatctttcgccagatgcttgggtctgaacaatccaggggtgccagactcgtctgtcatgactcgagcataatgacctgtggcaagccaccagtctccctccatgccactgttttcatgccgatccttgagtctgtgtttgagagaaccaaacttgatgtatctgttgcaactaacgtccggattgggcgtcaggccctgtctgtatctctcgagcatgggttcaaacacctcgagccagtactccttctccagactgagattcacggctgggatgtcgatatgagcacagacttgctgcacatcgttccagtcagcttcagcacatttggagtcggggctccagtttcgcataaacactccagtaactctccccttgtacctctcagccatcaaagcagcagtcacggaggagtccaccccagcactcatagccacataaacatggtcgttggggcccggcagaggcgttgtgaagcccaagtgactgctggaatagtgtctcagtcggcatggcacacccgtcagcggtctgacaagcttcctgagcaagttcattgtcgtggctctctaagttggtaattaaattaatttttcagaacctcgtgggattcgaagtttgatcttgatttgggttatcggcattacgggcctagctggtgtcgctgagtaatcagtctctgtgcgcatcgtcgagtgcatggtagacgtacgactggtctgactgtggtggcggttttgttgtgtgagtcgacaccgacagatccagtagccgcttgcatcgttctctgcgtgtcattgctttttctatttttacctctcaaacatctcatctcgcttggtttgcaaagggtgtgacaaagacgccgatattggatccgacagacagtcttccctccttcctaaacaagctcctacgtacttgtacttgcgccagtgcttgtacgagaggagaaggaaaagtgcccacagaggctgtgcacagagtaattcggcaggtactgtagaacgttgcagcgacatgtcagacatcttattattgaatgtgactgccagcatctttaagcgattcatacgtcacaacaagatgtcagcacaaggacgccgatgatcatatctgaggagtcgtgttggggtgtccaaaaaggggagtgcgtgtgattattcgaggagagctttttggggctgacaaccgttgcgcgtccaacttcacctgtgaacagcaccccctcccaaagcctcattaaatggtttagcaccagtctattgtttggcgtcccctcttattatgcaacgtgcgcaaccatgaacctgcgtgttgtttggtggcgaacctgtgaccgaggagccgtagccacttgtagtggtggaggagcagagctgcgaaatccaaaggtgtacattacatgagacaaggagggtgagcaagctaattgtagaagaggcagaatattattgcggtctggcaagcggtttacgacctgtttcgagacccttgtgcccgataattatatatcaggtctgtagtacaatttttctttggtggggtctactccgagtatcgtacttgaagtcggtagattaaaatgtcgctctattaatacactaatctctttatcccacatagactcacctcacacaactcacatcacacaatcacactcggctccccgtgacaaccctatttcaacaccaaggttccccattacacaagaacacaacatccacatatacacctctcacttgtacttcgttgtcacgaggaccggtcaaacacaaaaccccaaccgcgtgttcctaccagtatatgctcacgtggcttcagtggatcttagcattctccttcgccctactcaccccgacctacatcacccaaacgccagataacgcaaccaccccctccttgtccccatcatacccaccgtgcaacatgaccgttccgttccaggtcatcgagtcgtcggtcgacaaacccgtgactgacgaccgacagtaccgagtcatcacgctggccaacggtctggaggcccttctcattcacgatcccgatgccgatcgggcctctgcagccatggatgtcaatgttgggtccttcagcgatcccgttggcctgccgggtctcgcccacttttgcgagcacctgctgttcatgggtacagaaaagtacccggaggaaaacgactattccacctacctgtccgagcactcgggctcctccaacgcctacaccgcctctgaggaaaccaactatttcttcgatgtcggacacgagtaccttgagggagcattcgaccgattcgcccagttctttgtggcccctctgttcgcagcctccgccaaggatcgagagatccaggctgtcgactcggaaaacaaaaagaatctgcagaatgacatgtggcgtctcttccagctcgagcggtctctgtccaacccggaccacccttataatcgattttccacgggaaactacgagaccctacacacagagcccctggagaaaggcatggacgtgcgagaagagctgctcaagttctacaaggcgtcgtactcctccaacatcatgaaattggtcatcttgggtcgagagtcccttgacactctccagagctgggtcgtcgagaagctctcgtccgttgtcaacaccaacgccactctgccggactacggtgtccctctgctcaccgagggcgagctcggcaccctggttaaggccaagcccatcatggacacaaagtccatcgaggtcaccttccccgtgcccgatactcgagaacactgggagtcccaccctggccactactactcccatcttgtagggcatgagggccctggatccattctcttcttcctcaaaaacaaggggtgggtctcgtcgtgctccagtggggccgtgcaggtgtgtcgaggggctggcgtcttcacaatctcgtgcgagcttaccgacgccggtatgaaccactacaaggatgtggtcgtgcacattttcgagtacctgcgaatgttgcgagacgagcccgtgcaggagtggatctacgatgagatgcgggacgtggctcttgccaacttccggtttagacaaaaggagaacccttcgtccaccacctcgcgacttgctactgtgctccagaagaaccacctgcctcgacagtacctgctgtcgtcgtcgctgttccgaaagtactcgcctgaggtgatccaggcatttggccgacacttcaccaccgacaacttcaagatctttctggtgggccaagagctggagggtctcaaccagaccgaaaagtggtatggcacccagtactccaacgacaagattgatgccgactggatgcgacgagtcaagagcgctggtcgaaaccccgacctgcatcttcccgcgcccaacgagttcatccccacagacttttctgtgcccgacaagcgagccaaggaaccccagactcaccccacgctgctgcgaaacacagactacgtgcggctgtggcacaagcgggatgacacctttctggttcccaaggcaaccgtgcgtatcagactcaagaaccccattggtcacgccgaccccttcaatagcgttaaaactacgctactaatcgaggttgtcacagacctgctgctggagtttgcatacgccgccgagattgccggactcaagtatggcgtgcttgcctctcgagacggcgtggagatcgacctcaacggatacaaccacaagcttgagacgctgctagagcggattctgctcaagatcaaaaatttcgacgtcgaccagtcgcggttcaacatcgtcaaggagactgtgtccaagacatacaagaactttggctataacgtcccctatgcccaagtggcccatcactcgcagtacctgctgaacgaccatacctggaccgttcaggagaagcgggagaagattgagcagctgactcgggaggatatcatctccttcgtgcccgagttcctgcgtcacctacaggtggagacactggtggtaggcaatcttgccaaggaggatgcggtcagcatctcgcagaccatcagcaacgtcctcaagcccgctcctctgtctccctctcagctggttaacccccggtctttcttgctgcccgacagctcggctttccactatgacgtcgatctggaggacaaagccaacgtcaactctgtgatcgactacatggtgcaggtgggcaagttcagcaacattcgaacccgggcattgctggaggttcttgcccagattgggcaggagccttcattcaatcagctgcgaaccaaggagcagctgggttatgtagtattcagcggcatcaagtcgacccgaaccactcttctctaccgagtgctgatccagtcggaaaagacgtgttcttacctggagtctcgaatcgaaaattatctgattgaaattctcggccccatgatccgaaacatgagcgaggctgagttcgacaaacatgtggctgcagtggttgccaagaagctggagaagcgcaagaacatcagtgaagaggcgtcacgttactggtcgcagatcattagtggctactatgacttcaagcagaactttaaggacgccgaggagatcaagacgctgaaaaaggcggacctggtggagttctacgaccggtacgtggaccctgcatccaaattgcggtccaagctggtgatcaacctcaagagccaggtgaccaaggacgagggccagatccccaacagcgtgccaatcatcgaccatgctgcgttcaagaacagcctgagcatgaccgaggcgcccgtgcctgtggaggatctcaaaaactacatggatcccaaggaaaagttgtaatttagctatacttagagaggtggtactacagtacacaggaggatacacaggggaggatacacacactgtcatcatattacgtcatattactatagcatattcgcatgcaacatatacagattagtcaaaaaattattggtagacctgggactatagaagttttaactgggtgtacttgtacgagtagctcgaattgtgcgaaagctatcaatgccgtctatgtcatgctatagaagccccattcattacatggccataccataactgtgccgaagatatacagctattcatatgtctcttgtactggtgttgctatagcgagtgatttggtgcttccaaacaaataatgtaagtctcgtattgctgtcactcagttctgataaatacatcttgtacggaaaggattattatatgataatattggtagctatagtcagtttatcgcttagcgagtcgctctgctcgtcgttcacaagcgtgcttcacgcaatcgctcatctcctggttgccgtcctttgcaaagccttcaatgactccgtccttgtctccgcaacccatcttttcctgggacattttgaactttccctcctgcttggtgattttgatctcgataccaataatcttgggaagtagtttctccaggtggctatcagaggcatcagacaccttccatttcgatccggctagcgcttcctgctcatcgacaagctggttaagctggtccatcaggaaagctcgggtggtctcgtctttctcgtagaagaccttgacttttccgtagcactggactgaggcgaagttccatgtaggcaccacgtcgccggtagatggcttggtttcaacgtaatacttgggaggcacgtaggcctgggtgtgggtgaaggcaacgagggcgtcaggatctccggacttggaggcgtggatcagctgtttggcttgggggttgattcgatgcatgtgggctcgaagggtgccatattcgccatgctcggggccggtaacaagagtgaaggggatgtagttagcctgcagaggtagagtggcggtatcgtcctgaaggtgggtgatgagagtgcccagggcctcagccttgatgagcttctgctggacctccaggtcgggctcgttgtagtagggaggaatgtacatgttgatgtagtgggtgagtgtttgtgttgattgtaagaggagagagtagtgctatataagcaattggggttagccgcttggagatgttctgagtcaatgacaagagtaaatgacccttattttgttttttgatcaaaggccggtctgtcagtaacaagcttcactcgatgacctaaatatgtggctaaagaggctaaaaagaagttacgataagccacctgaggagaccaaatggttgcaaagataacttgtttgatgagcagcaggtaaaaggtacgaagtgattggatctttctggtggattatgcatccgttgatacccctcatactcgctacatgttcctctattgtcctgataagcctcctcatcgttccccacacgcaaacagtcatgcaggacattgcttaatcaggaagttattgccggtgggagaccaatcacagagttggcattaacgcgaaacacacttaggggtgggaaggaatctcaggtgaagtcgccgcataacgaggcccagaccatgcaagctgacacggccctcacgtgaccagagtcatttctcgatgagtaatcctaaaatgactcagatttacgattgactcagtgataattcttgttgactcggtgttttcttaaccagtttgacccggatcagtcagaccatacaactatccagcctcggtatccccttatggctcaagtccgccaggtggagatagcggaaacaggatcgatgagcaaaagcggtgaccgaaaaaatgcagagatgcatccggacgagagagcggtggtgggcgggatgcggtggtcaagcggaagctctatgaagaagctactgtgctgaagaagccactgtactgtgggggaggcgggtcactggaggtgggtcatgcaggctacagttcgtacgagtagaagtaatttgttagtttttgattgtggcattagttgagagttagtgatgagaacagtctatcaagaaaaaaaacccaccaactactcatctcctactcagtggttttattgtgagggtttccccgaatcgggggttgtgggcgtgacccagcgacatgtgcaagtaccggtacatgtacttcttgtacttgccctgttatcggtgagtccttttggagccgttagtccggacaactatacaagtactgatacaagtacaagtgggcatgtgtgttcgattcacctcaacttcatgattatgcatttacaacataacaagtacttgtaaactccccggatgcactttttttgccctcgaattatgctcagatggtacgggtacgagtacttgtgcatatattacatatgaagcattcttgtccatacctacctacccctactcgcacacagatgttgtccatccttttttatgagactccatccaaaataaagtttcgttcaatccacctgtgaggatcggtgcgggtgcttcagtctctctctctctggctaccagtgtgcacatattcttatgtcaaccacccatgcacgtccttcccttgtgcagattgatgcattgatgcatcattctcgacctttgccccatgagcactttgtgctcatattatttccacatgaccagtcagttgggctcagcccaactccctttgcgtcgcgagtatataaacaccttacatcctgtattgtaatgcatcgattttagtacttgtgttttctaaggaaagtcaccagtctgtcgacagcaccgtcaggagctctcacattcgcgcctccagcactagggcgatagccctaatgccctacaacccactcctttccctcctctcgacaagcaccaatactatcgtactgctgattgtgtaacgttctgaagcttccgctacagtcggttaccccacctggtatttgtgtgtgttccacacacataattaccatacatacactgtctatcaccacggcctcactttatccaaacgctctgtgggcagcatctacagtaacttgtacaagtaagcttaagcaacagatcaaacaaaagggctcacggactgggaaagttcaacgttttatcgtgggcgaagacgttggcaggcactgcttgttgaataacaagctgtacctctacaattaaacattcagtcatacagcgactatactcctcatgtgcaattgtctaaccgcaacgttgaactatttccgacgagattgaccgcgcacatctatgcagcagctaaaatggcaccttgtcctgagtacgatactgtacacgatggggttgcaggttaacctaccagcatgcgaggaacttgtgtgttgagtaggcaatctgaacaaagcagttgcaacttgtttatctacagaggtagtgtccctgggtacagtgtcactggatacagtgtgtacatttactgctgtatgtggacttttgggcatattatccgttttgccatcatgttgccatattttctctcgtcagttttagcacctgtcacgaacgaaagagatagatgaaggctaatataatatcccgccatgtgtatcgtggccacgttgattctgccattccatatatgctgtaactccgaccactcacaacactgtgtcttatcagtcccaccttgctcacagatgcctgctgtgttgtaattataatggccgggcgaaagggtacggacgtgcggcgataattttgcagaaattcggaccaagatgcggcggtccttttttctctttttttcccgtttttttcttgatctgggtttcaggtgcgctaattcgctgcgacattagtcttcagctggaagcaagtgaaaaatagggcaggatggaccaaggcgtcaagtatgtttgcgagcgggtctgagattggaagaggcggaaactgggttgcggcgtgtcaaggcggcacgtccaattagtgcaacggcaaccccaggtttgtgggtagttgatgaatgtgacagagctcgcacggttacagtattacctcaatctatgatttcgttaggcagaattattgatttttcgcctgccacctacagctgacactaactgatgtcatacctcaacgttattggtcaatgtttttccgggcctactactgtacatgtactctgcttgtaattacatctgttacatgtcgagatttgctgtggtgtctcgtcttaacgtcaggtatcgtactcgtagctatactggtgcaccattatgacgccccttctcggctagtaataccgcccgtatgagacgctagtggtcgacgagattaaaagcgccgcacacccggcacaccggtcctgtcgtcccttctctcacataattacttatacccatgtatctccccgcttatcattttcgatttcccttcaccttacattacaacagtacatttgagactgccgcctgcctctgccttggttcctctctctgcacactcgcatcaaagcaccaccacccacgaagaaaaaaaaaaacagcctttagagccaagagagcccaaaaagcctaacttaaagtttacattgcctcgagctctgtcatatcccaccacaagcgcatagtccccatcatccacacaatcggacctcttcgacccgcaaacatgctccgtctccgtccagccgtccgagcggtctccgtggctcgaagcgtcgctctgactcggtcattgcacgtctccgtcgccaagttcaacaaaatcgagggaaccgcccccgcaggtctgcccaaagaggtgaagcaaaccgctggccaccagggacaccaccaggagatccctaagcccgatgagaaccacccccgacgaaagaagtttcacttctggcgatcattgtggcgcctgacctacctttcggccattgcttctctgggatacattggctaccgaatctacgtcattcgaaacccctccgaccagttgcccgccgacccctccaagaagaccctggtggtgctgggttccggctggggctccgtctccttcctcaagaagctcgatacttctaactacaacgtcattgtcgtctctccccgaaactacttcctgttcacccctctactgccctcttgtcccaccggaaccattgagcaccgatccattatggagcccatccgaggcatcattcgacacaagcaggccgaatgccagtacctcgaggctgatgctaccaagattgaccacgagaagcgaattgtgaccatccgatccgccgtctctgagaactccaaggaggaggtcatcaaggagatccccttcgactatcttgttgtcggtgttggcgccatgtcctccacctttggtatccccggtgtccaggagaacgcttgcttcctcaaggagatccccgacgcccagcagattcgacgaaccctcatggattgcattgagaaggcccaattcgagaaggaccctgaggtccgaaagcgacttctgcacactgtcgttgttggaggtggccctaccggtgtcgagttcgctgccgagctccaggacttcttcgaggacgatctccgaaagtggatccccgatatccgagacgatttcaaggttactcttgtcgaggctctccccaacgttctgccctctttctccaagaagctcattgactacaccgagaaaaccttctctgacgagaagatctccattctgaccaagaccatggttaagtctgttgacgagaatgtgatccgagccgagcagaccaagggtgacggtactaaggagacccttgagatgccttacggaactcttgtgtgggccaccggtaacactgtgcgacctgttgttcgagagctcatgtccaagatccctgctcagaagggctcccgacgaggtcttcttgtcaacgagtaccttgttgttgagggtaccgagggcatctgggctcttggtgactgttctgccaccaagtacgcacccactgcccaggttgcctcccaggagggatcctaccttgctaacctgctcaacggcattgctaagaccgaggacctcaacaacgagatcaccaacctcgagaagcagtcggagcacacctttgacgagcaggagcgaaagaacatctttgctcaactcgagtccaagtcccgaaagctgcgacgatccagagccatgctgcccttcgagtactctcaccagggttctctggcctacattggttccgaccgagccgttgccgacctgtccttcaacttctggggtatcatgaactggtcttccggaggaaccatgacctactacttctggcgatccgcctacgtgtccatgtgcttctccatgcgaaacaagattcttgtttgcattgattggatgaaggtccgagtcttcggccgtgatatctctcgagaataagcgcataaacctatacaataaattttagattgacagtacaactgagggctgtaatgagtaagagtggtatcacttggttgtatttgacggaacagttgtatacaattataaagagttgcagcttctccatctgcagtattgctgtaagcatgtttgtggaaggtttcatcctgaacagaatccctcgtataagtgaaccccaaagccaatgttttagaggcattgagacataagactgcatgtttctttttgctcatttcacttctatatttcttttttgtgtctgccacttctgtataattcatttcaatcaacacaatagagttccataaggcgtgtggtgcatattgtcaactgtggatacctgttcgtacaatacgtgaacatactaacacacaccacaaatgatcacgaaaaggctactgcggttcctgctggggcctagttttgccaccaatgagaatacagaaacagaatctcttgctctcaaccacgaattgctcaacgccaaacacaagattctcaacagctatggacggtcttccctggaggccgagaagattgtacctcctcctacttcagccgctgatctggacgctctgcttgatcctgccgaatcaaacgactatgtcgacaagtggatgcgagcctgggaactcggtattatccctgaggggattgttagaggtatagagatgatgggcatgtggcccctggaggtatcttgggctagataccacacaattggcagatccggaggacaaacatactggcaactactgaagggaactatccacagcggcaatccgttccccggattcatggcttccctggcgcagagtatggtggaggaagctatctcagaccaaccggacgcaggctcgtatacgtgggagaacgggaccatggtcaaaagcgaacacaaaatcaacatcataagcgtgctcaagggcaaccacacaatggctgaaatcatcccctttgccctgaaacacttcacggcctgcatcatgtcattccccttcttctactactcctccatgcagattttgggggtgtacaacaacgtcgacacccccaacaactcgccctggggcccgtctattgcctggctgcagaatttctacaacccctggactccagctctacccaatgtcggagtcatggccgtctggcatgtatccaactactttcttggtctggtgggtcgaacgcatctggctgaaatcaacaagtctcacggacaaatgggacccgaagtggcccatcatatgcctccatttgcggttttatatgagaacttccttcgatcatccttcatcatgagatgcatgacttccaatctgtttggtttcttctttttccggtttgctgtcggcaaatcttttggggatgacctgcagattgatttcccagatctctgcggcgctattgctcttgataccgtggttagatgtggtatcaaccacttgtacattctgtccacctggattattgagagatctgtttacggggctgacacagaggaggaggagacgtaaatgtacataggtctacatcgctacatagttgcattatttatttggtattcaagaaagagagacatttttttcccctttgaactggtgtgctcgtttgttgcatttgtacatcaggaaacgcgtttcccttcgtcattccacattttaaaacatcacactcttatccttaatgaccatcctaaacggtacatgttgcttaataatcaaaccctaataacaagaatatgcatggctggactccccggccaaattcgtccagtacacatcttttacaccagcaacaaccaaacacaatgtccgctcgacgctcgagacgcaattttgatgacgacacggtggaagcgtccagtgacagcgaaggcaaaaagcgcaagtcacgggccgccgacaaagcagcagccgtacctgaagaggatgaggaggtcgaggactcggatggactggtggagtccgaggaggttacacggtgcatttgtggccacgaagagttgcatctggaccgggctgccaaggctctggaaattgatcagggtctgtttatccagtgtgattcttgctctgtgtggcagcatggctactgtgtgggcatgtaccaggagtctgaagttcccgatgtctattactgtgagaaatgccgacccgacctccatcagattttcctacggccaagcggccagacgtccatctacaacaagtctgccgacgacgatgaagacgaagaaaacgaggatggcaacgatgaaggcaatggtagccgggcttcggtcaaagaagaagagctcctcccgccaaagcgtcagcgcagcagccgagcgtcttcttcgacagcctcagacagcggcactggtgcaacacgcgagtctgcccgcgaccctccccgaagcaatggagaggagcctgcagctgctagtggccccagacaacagtccgggtccacccccgagcagggaggaaagcgaggtacgggtagaagtcgacgtcccgattctgctgcttctgccgctggctctgctgatgatggctctgaagacatctctgacgcaactggcgaggcaggccgtgactcaactcgcagcagacgcaattcgagctctcgtcgtgagataaccacctcgtcgcgacgtcgcaacagagacacatatgaggagactctcaagcgggtgcttcaggagagcgcccgcgaagcaggcaaggacaaggaggtcaaagaggaaaccacaacgagcaagaactctacgaccaacaacaataacgccacagccaacaacagcagcagtagcaaaaagtcatcgcctgagactactggcactgcttctggagcagcagctgcaacaaatggaacaaccaacgggtcagcagcagcctcgggaacgtcggaaacgccgaagcggaaacgcgaacaggaactccaggcaaagtcggatatggacggcagcgactcgatggactcgcctgtggccaaggcccggaaaaagcgcaagacaaagacgtcggtgggtgctggaggagcagccaactcgccgaagccgaaggagacacccgaatacaatgacgagcggccatccaagccacgggtacctcattcacgaactacaatgagcgagatgcgacgacgggtagctgcgatactggaatttattggccgcacacagatggacatggccagtgaccagaacaagattggagatcaggtggtgcttagctccacctctgcagatatgatggatggactaactcgcaagctgcttctgtgggaacaggagtacggtagatatggcgagcgaaggtgattaacagaatatacttaatttattgtatcattattatttaaaggtattttgccgtcggaatagccgctccgcaaaaaccgttgcacgttgtgtgagaggaaacctattacatgtaacaattggggatgtgtctcaattttgggtattgcgataagctaattgtagctgttactacctgatctacaaagtagcttagtgtcggttatcgatctctatattcgtatattagatgccaagaacaagaagaataatgtatgaagtagacatgtcatttcgcttaggtggtgctgtgagcctttgcgggggccactacaaataatagggaagttttgtatgcgtctgccatgtgcattgctccgctactattcacttcaacattcgacgcgtttctacagtcatggatgtgagagtggctgggtttatattacgaaaaggctccaatatgttgaaacatttagtacaagtacctgtagcttgttttctacttctccccatttctccatccctccaagaacactccacatcaagcaattagccgttgggaaagccgaaagtacaagtaaggtaagttgacttgaactacaggtacagtattagctgcctctaggctctcttatttctccacccaaacgcgcacaccatcgttcataccgactttgacaaacgtcattgttcttacacatacacatacaacattcaccttctgaattacacacaatggtccatgccgattactctcgattctcgtcggaatcaaagtccgaattgtacgacaccatggcctccaatgtggaagctctagttgatggtcagaccaattgggttgctaatctttccaatgcctcgtcgatcatctggcacggtctcaaatcgctccccgagccatccagcgacatcaactgggccggcttctacgtgattgatcctaagaagtctgaacagctgattttgggacctttccatggtcaggttgcatgtcaggagatccctctgggcaagggagtgtgtggagttgctgccaaggagcagaagacccaactggtcaagaatgtggaggagtttcccgggcacattgcatgcgacggagtcaccaagagcgagattgtagttcccattgtgttgaacggtaagctcttcggtgtcattgatattgactgtgccagtctagagggattcgacgaggtggaccagcagggactggagaagattgccttgattctggcgaagtcttgtgagtggtagcgaccattcagataagttataatgtgtagaaatcaatacgatacagtgtctcgttgtatacatacagtgcagtctatcaatacataaataagtcctaaatactggctggcccaaccagaaagcagtcctccacaatcatctcacccaaacaaagaagaaacacaggaaaatgaaggcgaagagaccgagccagactctccagccaataccgctgttgtcggccatgatcatcattcgcttgaaggtgcccttgagtttcgtggatgcattttcaaaagtgtcctccaggttgttgagcaggtggctggagtcccggatctccactccgatcttgctggtcacgtccttcagcagctgcaccttggcagacagaccctccatttgctcgtcgttctgggactccaactgcgacagcatcgacgtcgagtactgcttgtggcttttaggatcgtactcctcctgctcgggaacgtagggcttggcctctccaaaggacgaagacgacccggcgtacggctgtggaggttgaggggtgttgattcgagaagaagcctggctggaggctggtgatccgtattgtgccgaggaggcaaagagttgatgtctgagttagttgctgtgcacggaagagagccttcatcgcaataggtactcaccttgaggtcattgctgtttgttggtgctgaggttcttagactttcacaaacctcatgcacatgaacacgcaaaataaagacacgatttggttcccatgttagccaaataaggtttcgttgagcccacctcgtggtcattatttcggtggcgataagagtcgttgaaaaaaatgagacattgtagttgttttgacacgtcaatatttttgagtcatgtttttcaattgtcagaatatcatttctccggagctatttagtttgtttgctgtgtccactgtagaacacctcattcctgcttactgcatgaaaaaaatgagtgcgttgtgtcgatagtcgatatgaactgaggccgactcagaggcatagaaggagtgggtgatgggtggagagcagggtgacatgtctatagtggtgtttgtggtattgattaagcagcacttcaagagtgagtatgccgtatattttactgtagactgaccgtggctatttcggcagattggttgattatatttcgaaatattacatagatcagagttagaagaagtttctcattcgcacaatactatgaatagtctgttactccatagtctctattttttattattataataacataactgtaggtcttcggtccttcaaaactacttcacagtagtacagcaggtagatgcctcgcgccattactcgtaattgtagttcgtgaatagagttctggtccattatcaacgaacacatcttgctacaagtaggtaacattcacaatctgacagaaaagaaacattcatacaatgatcccttcaaaacacacgactatcaaagatctagacattgtcacctatgcattcaacgacaagatcttcgtcaatatccacagcaaaggagcatacactagatcatactatgttcccctaagactatctccaggcaatcagttctttgcacataccgaatatgacgacgaaggcgaagacatcagcaatctgccactcactcatctcactcccatgtcgctaattggaggctccaatgctgacacattgggtcagatcatagctgtccaggtggcgtcccaggtagtcaaggactcgcccacagaggtgcgaactgtgtttgtgtccatcggccgagtcagtcaggacgactacgacgacgttcttgagggagtcaagctttgccgtgtttggtaattgattatgggtgttggattgtgtggaggtgtgggagtggttgaaaaagagccttgtgacacccgtcgattcgtgtgcctgcagtgggactatcaccagactctttacgacgagtctgagctgttatttctgcggttgactatggtacaactacaagtactgtcctgtacttgataaaatgacagtcgacccggtacacacagtgtaagcacgttcatcagttgtgatcgacagcacctactgcacctacagcacccccctaggaacacaggtgctaccgcgcccatagcccacacttgtgatcattgcaccagaggacaactgaactagaataaaatttaatatcattgcatgactctcgatcggtcagtcgaagcgtgttctctgataaaggcaagctgggacagaaacagtgtgccagtacttgtggagtagaaccggctagtatgagaaagaacctgagccaaagaaattggtatgaaatcaatctaagaatattgtatacatatatatcgacacaagcactgacactcaatctctgacgcccatttgattcatctttgctcgatagtcaatattctgggtttatgcagcttacatgcagtcctgtcgattaacaattaaattctgcttcgatatatataaggtcgaaccgcctggaattaccgacgaacaccaagcttttactaacactttttcgttaacacacacaatacacaatggccggaattcagcaaccatccggacagatcaaactgaccaacgtggctcttgtgcgactcaagaagggccgaaagcgattcgagatcgcttgttaccaaaacaaggtccaggactggcgtaagggagtggaaaccgaccttgatgaggttcttcagatccctcaagtctttgtcaatgtcggtaagggacaaactgcgcctcgagacgacatgaaggccgcctttggacatactgaccaggacaagatcattctggagattctcaataccggagaactccagcttggagagaaggagcgacagcagcagagcaaccagctgcaaacggagatcatccagcttgtgtcgcaaaaatgtgtcaactccaagaccaagcgaccttatactgcaaccatgattgagaaggctctgattggagagctcaagttcaacattgtgcccaagaaatccgccaagatccaggccatggatgccatcaagctgctggtggagaagcagatcattcccattgctcgagctcgtatgcgaattcgagtgactggcgatgtcaagaagctggggctaggagagaagctcaagaccgatatgggagccacagtcgaggaggagacccacgacgagctggtctgctccattgatcctggtcagttccgacccgtgaacgagtttgttttggctgaggtcaagggcaagtgcaaggtcgaggtcatggaggttgctgttcagaattagccagtgatcagatgccaagcaactgaagcaactacccacagtctgacatggtgccccaacagcgaagcgcaagctctctatgggcctccacttgggcctccacttgtctctttaggacatgggacatgatatgcgtgtagcctattcctcggggctctctgcatatggggaacatgccactgctacttgtagtacacagatagttacagtactgtcaaaacaccatatatttaatgtatatttacagagcaattgtgaaggaagtggaagaaaaggtgttttttttgctgtataaagttggtgttccaagtaattggggtaaaaaaggggttccctggtcgtcttgtcacctggtactgaatgttgttacaacaaagtgcacatactgttcaaatgtctgtctaataatcaattttctataaatacaaggtactaaaatacttagtcgacctcctcgacagtggggccctcgccgccagcgccgggaggaggagcacctccagcaccagcaccggggaagccaccggggccaccggcaccaggcattccgccgggagcaccaccctcggctccgtagaacttcatgaggatagggttggcaacaccctcaagctccttctgcttgtcggagtactcctcagtagcaccagactgggtagagtcaaggaactcaatggtctcgttgatggccttctcgagcttctctcggtcagcctcgtcaaccttctccttgaacttctcttcggagagggtgttcttgagagagtaggcgtaggactcgagaccattcttggcggcgattcgagcagcctcggcctcatcttgctccttgtacttctcagcatcgttgaccattcgctcaatatcctccttggaaagtcggcctttatcgttggtgatagtgatctgctgagtcttaccggtacccttctcaacagcggaaacgttgaggataccgttggcgtcgacgtcgaaggtgacctcaatctgggggacacctcggggagcagggggaatgccggacagctcgaacttaccaaggatgttgttatccttggtctgggctcgctcaccctcgaagacctgaatcaggacaccgggctggttgtcagcgtaagtggagaaggtctcggacttcttggtggggatggtggagtttcgggggatgagcttggtcataacaccaccggcagtctcaataccaagagagagaggagcaacatcgagaaggagaagatcctgagtggaggaagaagtatctccggagaggatagcggcctggacggcagcaccgtaggcaacagcctcatcggggttgatggatcggttgggctccttaccgttgaagaagtcagagacaagcttctggaccttggggattcgagtggaaccaccgacaagaacgatctcgttgacggcggacttgtcgatcttggagtctcggaggaccttctcgacgggctcgagagtacctcggaagagatcctgacagagctcctcgaatcgggctcgggtgatggaggtgtagaagtcaataccctcgtagagagagtcgatctcgatggaggtctgggcggaagaagacagggttcgcttggctcgctcacaagcggttcgcaatcgtcggagagctcgctggttggtggagatatccttcttgtgcttacgcttgaactcctggacgaagtggttgacgagtcggttatcaaaatcctcaccaccaagatgggtgtcaccagcggtggccttgacctcgaaaataccatcctcgatagagaggagggagacatcgaaagttcctccaccaagatcgaagatgagaacgtttcgctcaccagcctccttcttgtccagaccgtaggcaatggcagctgcggtaggctcgttgatgattcgctggacgttgagaccggcaataagaccagcgtccttggtagcctgtcgctgggagtcgttgaagtaagcagggacagtgatgacggcatcagtgacctttccaccgaggtagccctcagcggtctccttcatcttagtgaggatcatggaagagatctcctcgggggtgaagaccttggtctcacccttgaactccacctcgatgttgggctttcctcccttgtcaacaatcttgaaggggaagtgcttggcatcgttctggacctcggggtcagagaactttcggccaatgagtcgcttggcgtcgaagacagtgttggaggggttcatggcggcctgattcttggcggcatcaccaatgagtcgctcggtatcagtgaaggcaacgaacgagggggtggttcggttaccctggtcgttggcgatgatctcgactcggtcgttggcaaagtgagccacacaagagtatgtggttcccaggtcaattcctacagatgtgttaggcatttttgttgttgaaatgtgttgtaaggatcgaattgaccggagacccctggggctatatatacttatcgcatgtcacgatggacctggtctctggaacattggagaatatctaactctatgcgccatatgcacgcctagagcctatctaaaagtcaattaagcgacttggaacctgttggaaataatgtcgggtggtggcaaacccaattgcggagggctgtggaactccttggaaaaaaggtgtttaggcacgctgtacctgggagaatcccatggaacactagtgacagcccatcggattttgtagtggtttctggaactttccagcccgaatcgccaccttaattgaacccttagtaaagccgtttgttgtacatcaccctccaggataatccggcctgctctggttgttgctgctttactgtgccaagtggtgttcatatccgatcaggcgcttccacgaagtgatgtcctctatgagacaatttccgagccgcatggcacaagagccgcttaaccttagcatgacgtcaacaggctggattgtgtggcgatgggcgacttggatacattttcgagcggggaaacgttggcgaggcagacactggtgctgagttgattttgtctcagtcgcgtttcctacaccaaaaaacctggctagttggagactgttgttatgtataccacaaaaaatcgaattagaattttccctcacaaagcactccggaagcacaccatggttgctaccaagaagagggattattgtggtaaggtactcgcaattgaataaaaataagacttgatcagatatctctatttctgtggggaaatattccgcctcagcttccccatgttctactcagggatcatcaaccacacccctcaaggactttccgtagtcacaatccggtctacagtaatatgtaataacaggcaaccgtaattctattccccgggagtctgaaaaaggatggaagctggtagaattgggtcgatgacttgagctaatcatccttctgactcaactcagttgacggtcatctgttccagtggtcattggagccccttgtcaagtccatgtagcgctattttctcagtctcatgagatatttttcctatactgatttctaggcacacccccagcgtgcattgctgccttatctgtacactgtgtactgtatgagaggagcccacatccttttgtccataggtcttccggaccctcgacatgatgcggctcgaaaatagcacaagtgatgaacagctacattacgagtgagacaagagtttcgctgagacacgaaggacagactcgagggcagacacgacacgagcaaaacacctccgctaaatactccgccctgaaatcattgtacatctgtggtgccccaagatcgacgcctggcaacgcgcatgggagaagtacagagaagactggagaaccggaggagcgaaccttgtgcgttgtcaggctgtgggtgagtactccctcacaattgaaggggagacgagtgtggctgagcctgtcttattatgtcatagtacagaatatacatgatgtacccactcgttgtgttgaggtacttgtacgttaatagtacaagtagaataaagtgtctaaccggatatttggggtaatttcttgtggaacgcatcaataggtcttgtggaacgcatcaataggtgatgagacgagtggtgggttcctgacgtacttgtaacatgttgactgggtcagttgttatcgctggcaaaggtttgaaagaaccaatctcaacattcatacccgaagtcccatacacactcaaatcaagatccatacttgggtcatcgcaagagcacaaaaagttggcaaactggtgctgaaaagaagaatgatgcccagaaacattcccgaatgcagtacaatcacttgtaattggcccacaaatctcaggaagcctcgctacaacgtcttctatcacgtttttgattcttagctaaaaagcatgcgaactgcatatcgaaataccagcgaaaaaaactctgatgtaagcagccgttcaagctggtcgtgtcgtagagaccgtgcctgacacccggggtgggactcgaacccacaatctttggattagaagtccaacgcgttaaccattgcgctactcgggccggtcgtgttctccagagctcaccatatcgtacttggatctaagttagcttttctaatcatccacgattatagttagggtatcaacaacattactgaagcttgagcttagtttaactgggtaggttaaaacatcaactgtacaccggagaaaatgtgtttacacagtattagcagttacacaatcagaaaccacccaggtttaagcacaatatactgcataaaacaaaacaactctcaattatcttcaatactttctcctatacaaaatttcgtcatctttggttctctcctccagagtttcgaaccagctcgtagaaataggcaatggtctcgagatgagcctggtactcaatatgttcatcgacagtgtggattccaaaagcggcggtctctcgcacaggattgaatcggtagatggcgtcacatagcttccagtagtgtctagtatcagtgttggcagtcatgataccaggagcagcaaagacgtccttcgactcggggaagactgcatctcggaaaacgtgcatagcggttcccattacgagatcccaggtgggtccagaagtaggagctcggggcgcaacctccaggggagcgccaaagaagccaacctcaatggagcccttggagtccttgtcttcggggatgatttcctttccaaaggcagtgacagaaaagccgttcttcttggcgatattaatggcgttgccggtggccttcttctggacgtcctcgaccttatgctcaatggcaattcggtggttggtgacaaaaacggtggtctccggaagagcgttagccttgacacctccagtgacgagatcaatggcctgggtagttcggatcaagtctctgtacttgggattcccgtagagaatctcgacgagctttctgtttgcccatcggtcctttccagcccgctggatcaaggacttcagctttggagagatggacttgtcatgggtagccacacactgcatggtatagaagattgggttctcgggggttagttccggtcggtagggggtgtcctccagctcgttgatgatctgggcagcaataccaattccggtatgaggagggggcatagaggagtgtccacctggagcagagacagaaatttgaatgtcagcatagcccttctcgccagtggcagcaataagcatggcgtagttgtcctcctcaaccactaggctgccttcatctacaactgaaaagaaagacttctctccatgcttgtcaaccaggaacttggccatgttcttggctccgttgggtccggagatctcctcgtcaaagccataggagaaaacatgggttcgcttcggcttgaatccctgttccagaagcaactctgccgcagacagagaaccaatgagcgagtttttggtatcgacagagcctcgtccccagacgtacttgccgtcaaagtgacctgagtaaggagggtgagtccactgcttagcagtctccttgttgacgggaaccacgtcctggtgagccatgatcaattgaggtccgagactggagtcagatccttcccaggtgaaaatcaaaccgtgggtgttaaccttctccacagtcatgtgcttgtggacctgagggtaggcagtttcgagataagaagagaagttgtagaagatgtcccatcggtcgtcttctccaacaggacctaggtcatcgtatgactgggtcgggacctggatggcgccctggaaccgtttaagctctcccttggcaaagtcgtcatcgtgaagaatgaagtccaagttggagtagccctgaggaacgagcttgggctgagaaggacacttgccctcgatgggcttgaatcccagaatgtcggatcgggagccataatactctcgagaaatatgcgacatcttaaagagagccataccaaagacggcagcaacgagtcctcgcttaatccagttgggctcgggagccttgggaatctgggcctcgaagtctggcatctgatgagccctgagctgctgtttttcgggatccatgatgtagagttgaagggtctatggaccaccccgatggggatcagcagtatacttatagttccttgcccaaaaaactatctaagaccaaaatcaccttaagtcggacttgcgcatatcggctgaaaccttggatggcggaggccagtcaaaactaacctcaaatgtcgctctctatgaagataccttcgagatcgggctgtatctaaacgtacaagcgggttattcatccacctatttcgctattatttcccatatgtagctcctccaagatataccaagatacatctgttgaacaatcgacttggcgatgccccaggatcatgcattgatagtccgagaatattcccctcaattctagtgagatggacgccattgagctttttgagtctgagagatgctgcctacagcatcaatggatctactccaataatccacatacttgttggtgtgtatacactggtagctcaatgtaaccatccctcgtgtcactgaacatctacgagagtacatacatacttgttcgatgcccacccagataacaggacatcctgtcaaccagcagtgatacagggaaatacgagcgtgtcacctagaggttattcggaatagtatattttcccgctggccgctctccatcccattacagcaacccgctccacacagctttgctgcctgtcggactccgcaaatatgatcccccgcattttggctttcatctcagtcgatttgggctctaagtgcctatttgggagaagatcaaagttgcgcttacaactaacgcatgcagcgttgaagcgctctggtggtgatagcggagttgcgaactaggaaagtccaaccaggacaatagctattagtgggctgtaaaaaaacgaaacaaaaacaaacgatgctattaatataaatcctgtcatggtggcaaaaaaaaattcaatcagcctacgctgcaaaaattatgcctcagactggaatcgaaccagtgacctttgcattccaatattagaatacaagtgcaacgctctacccctaagctacaaaggcgaccagttacgaacctaataatgtgggattgcaacaatgaacgtttggggttacccggctgaaatgaatcattagaacatacataaacaaggcggaaatgcattcacctagaataaagaaaaggcctttcttagaataaaaaaattctttagaataataataaaaaaagtaggctggattttatgtcaagatagagagcacctgaagagatatatcgatagaactaatgcttttgtaaggcactgagggagggtgattgcaatttctcgattgattctgccaatgtctccatgttaatcagttatggaaatcagatctaaccgtagcctatatcactattttaaatcccagaagtgcttccaggacgctggtaacacgaggtcttgttgacagctgaatgacttcagtgagattctttctgcccaatgctccaatgtttaaccaaaagcgagttcagtgcatgtgtacgcagaactggccttgacgggtgcattagacactatccctgctacaagtatgtactgtagttgttaataccatttctaaacaatagtacacactctggattcattcaatgcagcaagcactacagtgtcaatctgaataagaagattaaggattgtcacagtctacgagtaccagtacattacgtagtgatggtataccatttaactaactagcttattgtaaacaattctttcaatataaatagtgacgataagcgtcttttagggtggatattctgctaaataacttagtagaaaaaaccgaggatctttccagcaacgtgtcgtcgtcgggcctcctcgtggtccatgattccggcagaagtggtcaggatgatgtaaccaaactgtcgagaaggcagcaggttctggacccacttctccatatcatcaattttgacgttgaatcggggagaaatgacaccacacttgttgagtcggccgttcagctcgacaacgatcttgccggatcggtggtcatcaacgtaggtgaactcgttgatgtaacctgaagttagtaaaaacattcgtggaaatgctggggtgtatcttatatcaaaagaatgaaataaggaggaatgtaaccggcatataaacaccgaacaccagagggtttcagtgacagcgtgtaagtgcctttattaatttcccggacaattaaaagacagagagagacagtgttcagacaatccatccagttatcagcccgggtgctcttagtaacaagagcaaagagaaaaaaacgagtcagacgacgcgtcggcgtaaggagtacttaccatgcttctgcatgacctgcaggaacttgatgatgaccttggatgcgggtcgaatcaggacctgtcgcttaccagccttctcggcgttggtgatggacttgagggcgtcagcaagaacagaggttcgagtcattgtgagatatgtgctgagttaagtgggacctgttgttagtgggtgaaaaccacaagagtatccggggagggatttcatgtggcatgtcgcgagtagcaacgccacactagaagtgtcgcagagtgtgttgaagtgtcaatcaaagaaagcggcattaccaccgtcttccataaacagattcaacacataaccacgattttctagtgaggtaaaacgagggcagtgaagtacatacgtttggtgatgtgtaattaagaggagaaaggagggaagtgacgtggtgttataagagagaatttttcagacagggtaacttgggagtttgagttgcgttagggtcttttgtttgaatttgggtggtgcggttagggtatggtttggagtattgtggttttgagaatcaaaatatcagatatgatagctataattacaagtaaaatctattatatatgacgagtgaattagatccgaaggaatttgggatccttgcatctcgcgccttcgtgctatgattaaatatataaattaaatgctgttgtttccttcaccacctctctaacgaacataacggttcatgaactttcgatggaaatctgatcgaatgagatcgttgacatagctgtcttctttccgggcctgtttggtttggtttcggaacaccacatcctcgttccactttcgcttgatggctacgggattcatgagagggtttccaaatgccacctgctcctcccgggcctttgcttcctccaaagctagccgttcctcttctcgagccttcgcctgtgctcgttcctgcttgattcgctcgagttcgattctaagcagctcgtcttcgtcatctgagtctgagtccgagtcgtctgaatcggactcctcatcgtcagacccagagtcatcgtcatctcggttctcctcaatgatcttggccttcacttcatcggaaagttctttctcagagtcttgaacctgagtttctgcctgctgctgctcagcaactagcttcgtggcggcctgcttgagtcccccctcattctccaacagagtctttctcatggcatctgtgtttgtactaatccgagcatatctgtacttgagcttggtgtgagacgggagggaccgggtatgtgagatggacccagcggcctgggtattggacttgcctcgtgctgggtcaaaagtaggtcgatgtgctgtagtcattaggtgatgctgtaattggacagaaaatgtattgtcaactggatgtgatgagtttttaaatcagctgccttgtattgttcagctgtccctaatgctatgatcgatgcggctggggttacaccgtctgtttgtgctgtcgtgatgtggaagtggtgatgataagggatggaggttgatggttcctcatgcacctcccaaatcttttgctcacgttctgcagaccttaactacgccacaagtagactttgatacgagtacttgtatgatgttcaaacaggcaagagaatttccacattagtttgcttgagtttgaaactaattttggttactgcagcacaactgtgaagagtatatatattgcctactcgtcccatggactcatgtcactatgtctaatgcattggcctctgttattacaccagatcacgtcatcacatcacttcaaaactcggcgcaaccctacggagttgctgctcgctgcacccactgctgcttgacatgtggcgttccaaggttttgccgaacggcgtgttgaaggctggcttgctcagctgaacctcatgtgtaacacagctgatattttgccgtggaaaaatgcgtttggaacgttgagcagcgacatggctatcccccagagaggaccttggcaagtgcgtcttttgccactccttctttgtttctctcattaaccccgccaaattttagtattattggcagtcacattagattaaccgcttttgctgaggcaagagaagcagtgctacgcactactttggtgttggaacatgcaataattacttctaaatatagcctgtatctgaaaccgagtggaactcgccacatatagaggattcaccgttactttgtatattcacgcacgctgccagcgagagttgaacccacgatccccacggcccaccctgctccagagctccaaacctgacattaccttacatggcatattgtgttagcccaaagaaacactgagccagaaacactcgtgttaagtgacaaccggcgactctgaccgaaaacagcacactccacacacagcacaggtgctataacaaccacagcaagaacacggacaaagtcgcgacaatcgccgtcagcactccacgaacacgccagacaagaaatattggccagccactttcagctgcacacagcattacagagacattctggttttgcagcttctcctaccacacgaccaaccaagcgcttgcacgaaaaataaagagccgccacaactaccccacaaccagcaactcgacgctccgcggaacgcactagacgaatccacacgaatttctttacccatggcagaaaacacaagccaggaggtacttgcaccggcacaggatgtacaccctgtccacagtgtgacacaggacctggcctccgtgtcattggacaacaaagataccacagagccaatagcacacaaactgcgcatatctacacagcgactgtcgaccctttcggatctgggcgagtcgcgcgactccccctccaagccatatccggccgagcagtctccttattatcgtcggtctcggcctgacctcagtgagtcgtcacgacggggctctcgcatctcgcaaagcagcagcgatcctctcaagctggaactagcggcgctgcagttccattcgtcactggactatgccattgtccgggactttggctaccctccccaacaccccctctttttcggcgcccgtcaaagcatgtctgtggtgtccagctctcttgacgaggacgacgatctggcatacccaccaggaatcggcgagggtccaccttactacgaggactcagacgtggacgcagagctggacagcgagctcaacggccgggcagttgcgcttttcgatttcgagccggaaaacgacaacgaaatcggcctgttccagggccagattgtgtgggtgcactaccggcacggccagggctggctagtggccatgaacttagacacagaggaaacaggattgattcccgaggaatacgtgcagattctgggggaagacgaggtggtatcgcatggtttggatggagaggaggatgaggaagaggcctcagctgcagctgcagtgtcatcagccgcggccgctctcatggccaaggaggatcagaatcatgaagaagttggagagatggagctcgaaaccgacgcgggttccgttgttagtgaggaccaaaccgtcaccggagaggacgacaaacctgaattgagctagcaggcacccacgtgaggcaccctgaggcatctcattgcgtcagtcacggactttgtgatacgctacatatacgctccagtcatgccctggaccatgctggtattattggtagacaccaaacagtacatccagcatcttgcctcaaatgcctccagtaacaccgtcctcacagccgttcgcacacaatcttagcaaaatcttttagcatgactattgtggtcttatgtataataataaatcaatggtatatttttacgcttggtcagtaagcaatgagacacagctatgcaagccgcgttatccagcgtgttattggacggttatctcgtatacccacagcagctaatacgaggggtgagcatttctatacatttaacgcctcttgtttgttatgctccttagttataaccccccttcctggattatggtgcagctttatcggaccaccttgttcgtctgatagcgtgattatagtagcgagtctcccttgtctgactgttatttgtttataccactggcgtttatatactactatgagaacattacgagtgcctggtataggctgggtgatggtttaacaggactacacattctggtcaactgcttctgagtctgaatctgagtctcactgcgtactgtaatgtgaaacagaagatatggtaagagaaggtgttcaagacgacctgaggagtaacttccgaactgtgaacgtagggcctctgggtgggaacctgtatattcccacgtggttctcctttatcaggcgtttaagggacttatgagggcttggtctacggacaccaagaccgctaagggctacttgaagtgactaaggtatgctctgcttctgctgcacacttgtgtgccgaactgggacaacaacaagagagaaacaaaggtgtaaatatccatttgaaaccggggtaaatgggtgaaacagacttgagcggcgcttgcatctttcagtaattattatagcagccatatttgccacacctactcgttatggtatgttgaatacatgacccgtctgttcagggactgtgtgtgcggtgtagtctgtaaatacccatttctgaatgcactacctccaaacagatcaaggttgcaccgagacaaactctgtcggcatgtgactttttcagccattactgccatggcgtatagttaggttcagcttcacattccggagtgggtgttgacaatagaatgtagctgattgacctgctggccatccaataggtggcagttcttcgcagccaatcactcgatacaattggcaaaccaaaaaaggtctccacattttcgtcgtatcgactgccttacatctgtctcaaaaccagccccgcccacattcccattcttcgcgtcatgcaggagtctgtcatgggtccacatgcacacaatagacgtagaagagcttgttgcagaaagggtgtcataataccggcacacctctggggcctaatgcgcattacctttacccacctattatctcttttcttctcctccctcactcgcgatactacctaggagtcctcttacccacactcgtttgaacaccctcacctctctgcccaaatcggcactctcaactgcaccttaatcttatccgcgaaccacacaggtcatcgcgacaggggcaacaaggacagcactgtaacactgtacagaagatatcgacgcgtccaactggtgcttctgactggtttactcgacaggccaattcctagacacaaccgaggtcctcgatatccaccacatcactccaccccatagcattcaaccactcacactacacacatcacttgcatcatgaacagagacgaggccatacaggccacactagacgctctgaaccaacccatggtccggggcgattcgtccgactacctcaacagcagacccagcttccactccagacgatcctctatcatggcccaactgtccacacccaaccaccacgccagaactccctccgtgtctatgtccgactcggatctcagctgtatggacgagaacaagcgccggagccgcatatccattgatttttcgggtctgtactcgccagcttcatcgactggggactggtgtgagaaggaactgcttagtcctgatcccgaaatcgagtccctcgacaagaaacggtcctccaagggctccgagttcttcaaacgatggtcgctgggacctgccacaagcgtcacccaagtgtcacgacaaacccaggcacttttatcgccccaggagttccacacggccgagtttgaacctcaatcatgcatgtggcaacgaacactccaggagatggcccgaacagataacacccgtctggcactgttggctcgaaactcgaacgcaaactcgtacccactgcagtctatgcacaacaggaaacgccactcttgcgactttaccagctcaactacagcttccaatggtctgggtctcggcctgggccctctccgagctagcactcctgtaaagggccctaacaacccatttgtgcctttttccttcgagacgggtagtgaagagtccacagagtcgcccgtccacacaaagctcaagcatcggacctccatgtctcgaactcggccgctgtccatgacacgatccacgtctcaaaaattcaactctggtaacttttcgctcagacaacgggcaggaacacccacgccgaccagagacggcgacagtacgcaagtggatagctttgtttttggtgctggagacatgtcttcggactcaaactccactgccgtggaccctctggacacccaacacacccaggaggtgctctccaaaccgcccctggatcccacaatccccatcacggactggagccaaaaggcccagctcgttaaacttatttgtgcgtctatccaagatgctcccactatgatggcgtacatcaacttgctatggaccgccctctccaaccccgagaacctgaatctcaacaagattgatattgttccaagctcgctggaggacgttgctgcgctgcaggacaacctggttctgtttgtgtctgaaatcgacgtgaaggccatggtctctgccggatggatccggttctacaaggtcatgtatgcgtctgctgtggtgtctgctacaattggactgctggcattccagaccttgctgctactgctctacctgtgcgtggcttcggtgatcatcctgggtagcaacattttgcacaaatttgaaaagaagacccagcctcaggaggctgcaaaggtgctcgctaaggagtgtaaggaggagtaattaattatagggtgcacctaaatagaatgcatatggctcacacgccaaaatatattaacacgtaatacaactatcgtactgttctcaggcgctcattgttcgtagaccctcatgctacactgactacagtaaatcatttgagttgagtacataatcttgtgtgacttagaagacctgctacagtaaaagtacaagtacagggataccagtacagtagctactgtcatacagtagtcggtggctccatattagatcccacctgcacaagtatttacagtgtacagtacttgtacttgtgctttagtagtcaactaatactgccaaacgccttagctgataatataatcctttcagctgataggggtgccgcagggccgaaagaggcaactaataaacgaataatgggggctctcaaatatgatcgattctgacataataccagcccgacaggtcgacaagtctctcaattcgtcacttcgaggtacttacacagaatgtatgtacgagtacgatacttgtaaacggtatctgccaatctcgatacttctacatgtgaatagtctgacagtggccaccatactgtaaacagtttacaagatctctctttctcttaattcatgcttatccttatattcataactatcattaaacagtttactgttgctgttgttgtcccattgtagtttacatcttgggaagagaaggaccaacataaatttcctccaggccctttctgagatccgcgggaattggaaccgccttgttggtggtcgagtcgacgaagacatgcacaaattttcccagagccttgaccttttggtttctcagctctctgaacagagcctcttctgtggtggcaggtacgggatcttctccggagttggcccaggcctcgtagacaatgctttctgctgactcctcttgctcggccgttttgctctgttgaaagactccgatctcaaactccacagacgatcgtccaagtttccgtactgccagaccgagcaccagaggtttggggaatccgtcgatgatctcgaagtattctgagcctgaggcgaccacgagagcccgtagatcgcccatcacgttatgtttgcattgatcccagtagtatccgttaacaagtgcatcgtagaagtggtagtagacagcgttgttgagatggccatattggtcgttgtcagaccatcgagtcgactgagtaaccacgaaggggtactccttgagcttgggtcgtgtgattcggggggccatgttagatgtggaagacgtaaatagtcgtttggtggtaggtgtatgggccgacagagtagagacacctttaatagaaagattcagagatcgtaacatcatgggctgatataagagtgttagagttacctcggcaggtgagtagggtggagatggggaaatacacacagacaaacaagactctagagacgctgtcacaattacgagactactacaatgccatttattctgcttcagattatcaaaattcagaccatcattactacatcccacccttgcagttgaaagacctcggtaaaaacactaattcatgtgatggcggccattaccccgtggggaaggttaataaatatggtgggggaggggtgataattacaattgtcgagatgtgacgctgaaagagtagaacttcttgaaaattgtgtacaattgcatcccacttaaaacttagagtgtgatttgtacaaaaatgataccgtttgtcatttcccacctctttgcttactaagcaacataaaggctttgcatcaccccaattaatccgatcgaccgaagtataatatccagcgcaagtttcagcgctccggaacaattgttgccctgtaacagattgaagatcacatgacccatcttccgactcctaccctgtctttgaggtctcttggctgcattattgtgggttattgtggtgtgatgtttcggaaaaagtggtgcgaccattgggagtgtacgagacttggattaaccaagtgaacaagcaccaacagtaggatggtgttggaaagtgcccatggatagctatggatgtactatttagcaatacgggagatgagtataaaaacatgcatagatgggccgattgcttcagatgacaagagaatcattgtggttgatactcctttctctgtattatgacacctccttgattactggttgattcaggcttcagactttccatccttgatgcgaactctgaactctgcctacaggtgtacgagtatatatactgatcaaagaacgagtactgcttactaacagacccaccgactgacacaaatgccgtacgatccaaccacagcacgtccttctgtttatttgcactcttgagacgcacgtctacacggcgtttggcactaaaccccgtacatattgcgcaggcgttggggtacatgaggcaaactttcgggctggggtcgggatatgatgatggtgagaatgtagtttcggggatgagtcggtgttgtagaagggaaatacgtggctgtgctttaaataaaagaatgggacagattacgtagcacgtagataggatggccacgttccatactcgtaatgtattcgcatacactgttaaggatcagctgggttatactctgctgcctggctttcatgtatgttggagaggaggcgtattgtgtggttgtacttgaggttcgttagggtcttgtatatacagcgcgaaatgaggcagcccttgtaccggtagctaataggcaagcgctttttttggtctacatattcaccccatgccattcttaagggcactgggatttgtattgttactggtcggaaagaatcggcagcactgtgtggggagactgggatggccgaatatggcgcagctgaaacagggtagttctcccattaattaaagatagaagttctttgcacagccagagcccgccagccgggtagcatacccaatgactcgttcacatgactataaaacggacccggaaaaatccaacatttcgctctacatgcagatgcaggttggcccggaaatatccggatgggcggtcaaactagcaagtggcgtgtcgattaaatacgggcaagaacttgtgtttgtagtaatgatatgaagttgagccgattggggtgtctcctctctataagtactctcccctcattttgttcactcttcccccaccctacctcaaccatcatatgatgaacctagttgctgtgcgtctaactagcctaaccttcgtgcaaccttagttcggggtcagtagatatacaggccaggacacagctctagctttccattcaattgcacccagagtgtagtgagtgaccaaacgacacgaacggcacgcaatcaacaccgacacaaacagatccgacaaacactctccttctgacacacacagaccatgtacaaatacatgactcgcgcggggtccaaagtggcctgccgattcacccgcaacatgagcacccaagcacacaaaagctcgcccggcaagtttcgaaaactcgttagactcacggcgggcggatgtctcgtgggatacaccgctgccgtctttttcgcctctcgagacgagcggttcagagacatttttatcgaaaagttcccgtttggccggcccattggcgagtacttcgaggagcaagaaatcaagaaaaacagagactcgcccaagcccaagcctattcctacttctccttctggccagcccaatgctcgaaccagccatctgtcggccctgtaccccgacaaatccaaccctaacgccatgaccaacaaccccgatggggactcgcaccaagagcgaaagttcaacctcgagagagctctttcttccaagggcaccaagaaggaatactttgaccctctgactgagaaccagggcaacttcttcgacccctcaagtggagtggttgccgaggaacacaaggagtacctgcccctgattctgctgcacgactcggccgaccatgctgcccgacactcggctatggctctcaacgacctcatctcctccatcaacacctccattgtcaccaacgactcggttaagaacgtctccgactcgctcatccagctgtccgagtttgttgccgtcaaccaccccgagatccagacccagctgtctgagcgtctgggcgaaaaggcccgccgattccatgcgctgggcgagcattaccacaccattatccaggactttctgcaaaacgaggtcgagcacgggcctcaccagggccacgccgcagaggtcgaattgaccatctacgagaccgacaaaatgagagacctgcgaaagaacgtgatccaggaaatccatgatacagaagacctgctggtgaagtactgcaaccggtactcgcgacccgagggacccgtagcagaggtcatcactcgacgggtgcccacagttgagactgtgactctggagcccattgactcgactgccaaggcagcctttgacgcgtccaagtacaagtctcagatctcagcagccgagcagtcgctagccgtgctggtggccgcagtgcagcactcgtcggttctgggggtggacccgtttgtggagggcgtcaagcaggccatcaacaatgtggacattggagatcggtccaagattctgaccgaggctctcaagaacgtgactgttcccagtgacgtcaacctcactccttatctggagcagatcaccgacaagagttcctaacttgcaagcatttatctaacgttattgattatggaaacgatagactatggcccgtagggttgtattgacatgaaaccagaccgaagtgtaccatacgagtgtgtaattcggaggaggcacaaaaagggagactcaatgtagaaatgttcacaattgaagttgggttgctcaatcatattgtgacagttatgttcagcagcatttacaggtggatgcacgacatccgtggtcaactcgtacttgtcacctgaagatgtggtaagttggaatccactgtctttcatgtgtcccagacactctagactcatgtcttgtaccttttatctggaattagtaaaggtacgacttctttatcattgtctccttagaatgcatctagagagagaaatgacacgcattgggcgagttggcttagttagcttgtatagatattttagctacgcaatgggaatatactgtacagtaccaagaagtgccgaacgtactctccataatcacatgatcttggcacacggctgatctcgttcacatggagtgcaagtactcgtatagcagagaggagaagatcgccgtgacatcgtgttgtcacatgtatggtgtcgggcagtgagcttgacaaacattagttaacgaggcagatgacagattatagaccagttcgactggatgcctgaacgggtttcgtcagggttcgtcagggtttcgcatggctgtcgtcgacggtggaaattgtgtaaaactcgaactgaaagttcttttggaagttaaaccatcgttggtcgagaaagcatctggagatgatagcttggattctcgaaaaagttttcaatattcaataatacacggacacacctccgctacgggggctacggttgagttgacgcatgaggagctacctcttcgtcggctcgcgttcaataaataatatcgattgctcgcaaatgtgttcattagtgcattttctaaatgacaccttttgagatggctaaatgccttttgtaacttccctaataaaagagttgtttagatgtaaccgatcttgttggcaatgtcaagagcatcgtggtcggcggtgagtcggacgaaagccttcttcttaccgtcgggtcggatgagggtgttgacagaggcaatctcgacctcgtagagcttcttgatagcatctcggatctggtacttgttggccttcttgttgacaatgaagacaagggtgttggagtcctcgatcttcttcatggcagtctcagtgttaaggggagagatgatgacatcgtaagagtccattcgggggtagtgagcaacggcctttcgctggtacaggggcttcttggggagctcaaggaccttgggtcgtcggaagatggtggaggatcggtacttgagggtcttggagccgttggtacccttgagggcagccttcttggcgttctgagcttgagtggcggccattgttgatgtcgtgagtgtgagctgaggaactaagatttttgagccggcggatttgatgtagtgaaaagtttggcaccgctttaggttagcctgtgactgtctttagggctaaccctagactaaaggcagggtaactctgtgtgggagcggaagatgtggtaggggaattattaccaggtaaatatttgtcttgtagtggcatgtggacagaaacattcaaccataatgacgatttctagagctatatttagggtcgtctaaaataggtcacgtggatagatgaccccaaaaaggacgaaccttaaacccttattggtagacggagtttggacttggtgatgggatggatggatggagctatagaagtgcgcgttcgaagatcgccatgcactaaataatgggccttattctccggacttgttgcatgttattgcccaggagcgtcatatgactttttgcagattatgtcacgtgataaagcattacttcgaagattaatgtgctaaacgtctacttgtgcgaactgttgccctacaatacagagtcagtaggtcgtctgttgacatacaacaagtactcccaactaaacttatttaaccgcggatgtactgcaggttaatatctcactgaacattgtggaataaaagcacaggtataaggcccgccacgcagatacactattcaagttcattactaatgaaattcgtatctatcggccatcattcgggcttctaccgttgctctgttgacaatggtgatgtggggcttcttgcatccagaggtgcgaaagtggcggttgaagcccatgggatcgaatgtatgtccacattgggaacacgtgactgtaatttttttctgcgagttggggactgaataatacatggagatggagagaatggatgtgtttcatgggcttctccctatatactggtattttgtggaatggtcttttggggcatactgaccagtcgccttcttgtccggaagtagttggaatgtgcggtgtgaaaaggtcacaatcctgacgaataacgggcttcgtgggtcagtgtaagtactagagggaactatctcacttgctggagcattgtacaactacaggcatgaaaaagtcaatgagtggtacttgtactccaaagcgacactttcaccgttctcttggtatgtgtgctgtttggacttggtatagcatgagcaaaggttgaaatgtttcccttgagagtggtcatatcatgctgaagtcgcaggaaaatgataagtcatttttccacaaacatgacgggcatccacagattgtgatccacatattgtcaaagcattactcaatacttgaacttttcgactgtccatcatcagaatgcttccagattaaacccacaacttcatccaggacgatagcaacttgacacgacttgatcgatctcttgtacgtattgaagaaatcgaacagaaggatgaatgacttcccatacttcctttccatgtgacgagcagctcttacaacaatgcagacccctcatccagtagcgacacaccaccacgtaagggaactgacatcggctgctgaaatatagattatctctgtcatttttttcagacaaaagatgaatataatctactgatggggtaactcttagacagtcccaagagccgtgggagctgttttttttctggacccaatgtcatcccggacttaagcggagatgatgtcccaaatggttgtgacaaatgaatcaagagtgggtccgtggtgtctcattcaccacatcgagatacacaaactcccttctaatgaatagttaacagctggaccaccatttatacctgctatacaaccaatagtacctattattatacacctcatgtcgatactttcactttctgccactacgatgttttcacatctcgtatctctcgtgtccatcccacatgagtagcgaacaaatcgcactattcaaagtcagtttatgtttaatatgggtccatttgagccattacatacgctgattagggtcccagaaggctacaaatagctgccgtgcctcggcattcttggcagatcgatgtgccatatctacatatcctatttggcgacattcaaacatacgaaaatcacaaaaaattaaaaacgctcagatctggaaatgtaaaaatagtaatgatggcacaacagcgtccccactcgcctccccaacatgcacttgtcaaagtcgttccgatcgcaaacaaacgtaagctcctagatcgaagttactgtaaaacgaggtgcaaatctcgtcaagaatacgaccctgcctatctttgccaatatctacagcactcacgcaagcagtaagtgaagtactgtaacccagaatcacatacagtatacttgatgttttgcaccatatactcacctgtctgactgttgagacctcgaaaataccaccctgggcgtaacacagttatggctgccgatcagtctcgattatgatgcacacctcatttatacattgctcgatagctcttgtgttgctcctgttggtaagcatagttatcacttgagtcatttattgcagagaaagtgtgtgtaaccaaaaatactggtggacggactttagcgcacccgaaaagcgtactgtagggagagcgagagagatgcagatggtctgtacgatcggagatactgtatgtactactctgtgctgagagagataataccgctgttaagaagagaccgaatatgaatgaatttcgacactgcgcacaaactatttggttgattcagccactcactcaccaacagtcgccactatacggacgattctcggagataacccaaacgtagccgcttggcccgaaacaagaaaccacagtggtgtgctttttgcactttcagttctacaatcgcatccgtttcgagtaaccgggcttagcgtaactgtctttagcttgacacagtacagtagctactggtagagacaaacgcaagtccacctaagaggcgttgatttgtattgaaaaatcaatctgggtggggttatgtcaacacctcaagtggcgttgataaaacgtatgtcacatcacatgtcttaccaattctacatgctgtacaaccatagactgccacttttcgtctgaactcgtacttgtatattatgctatgtattaaaaagagaatgcaattattgatgagtggtggtgtcggggtactcaacggagctgttggagttctctccggcagtctcagatgtatatccctcagggacctcctcatgttcgggcttgggctcgccctcggggtattgttcgcccatggagttgcctcgagactcgatgtcgtagttgtaatggtctcgcttgggcattcgagcagcaatgccaaccacgtcccagggggtcttggggttagactccttgaaaatctcgtcgatctcctcgagcgaccggccagcagtctcagggtacaggaagtaaatgactgggaccatgcaggcgttgatggctgcgaaaatggtataggtgtacgactggatggagttgaagccgacaggacaaatcatgacgactgtgaagttgaacagccagttggaggcggtagagataccggacacgggggctcgaacctccagtgaagtaatctcggcgggatacagccaggtcatacccagccatccaatggcgaagaaggagttgaaaacgaagaggaagacacaagcagcaataccagcggctcgattgtccttgttgttggggtcagcggcccatgcggtacctgtaagaatacccatggtgcaagcctgtccaacagcaccgaaaagcatgagctttcttcgtccgaatctttcaatagaccagaagggaatgaatgaagccatgaagtactcggtaccgttagctgcagcaagagctcgagagacaacatcgtccatatggagagagtcctggtaaatcttggcggcgtagtaagtaatcaggttgataccggtcagctgttgcatggcctggttccagaaagcgagacaagctcggtggaaatgctttcgctctccataggtgaaaatgagcttgaaagtctgccaggaagtcatttgctcctctgcagccagattcttcttgacctcgtggatctcgtagttgatataatcgtcgttgggaccacagttctccagagcagcccaaacctctcgtgcgtcctcctctcgaccgaccttgaccagccatcgaggagactcagggaactcgagcacaaaggcgacgataatcagagcaataagaatctggaaagcaacagggaaacgccagtccatagaaccgaccttgacaaagaagaaggcgaaatcaagccaataagaaagagcaatacctccggaaatcagacatccttcaatcatgaccatgagaccacgatcttcgggacgtgcacactcagattgccacatgggtacagtggctgtaatgagaccgttaccaatacctgcgacaactcggccaacaataagttgaccaagatggtaagaagcagtctgaataatagcaccaatgatgataatccaagttccaaaataaatgacttttcgtcgtcccagcttgtctccgaggtaaatggtggaaagagctccaaccatacatcccagctcgtaaacggcaatagcggtaccttgaatggtagcagtatgaagagaagtgtcatcgacagtgttaatggtctcgaactgctctcggaaagtcttcaagttgagcagaccgcccataacaccttgatcgtatccgaataggaagaaaccaagaccggcgatgcctccgatggctcgctgaagagtcttgcctttcagtccaaagtactttgtacctgacgctttggaaaataacattgtgagtcgggctgtgagaaatagtgaccggcttctggggacctgtccccgtatatatatacgatactcagatagtgcgaagacgcctctgtgtaaccaaaaaagtatcatacctaagtctattgtgatacaagtgcagtaactctgggttttttttcttattgctccatgccgacagagatgacccagaagtttgtttgtgagagtctattctggtgagcaatccatcgcactaattttcaggggtgtcgggtagtacaacacgcgtggattagaaggaatactaccaagacttggctaggaatttataaaacccaatatgacacgcgaaaagtcgggtttcctccttcgcccactctaacaccggttccccaccacctcggcttttccctttacttttcttctctttctcgcttgcttgccttatttgcgcatccagcggctttttttttttgcacttccgttttgtatttacgtcagcatggaaaggagagtgaagcactaattttaatccgcggaggagacacgctcgatgggtccacatctgactcgtgtgttttggtcataatttccacctgtaaaaagctgtaccccgttacactagtcagtgatttaaaaaagccgcaacatgattaatccgatgccaaggatcacaactgccttgttggtgcgagacagcaatgtcagggacgtcaggggcagttgtataacaaagacttttagtaaggccaagtctaaagtgacacacaacaagggacatccgaggtctaatcgtagatctgacccgtgatatctgcatgccaaggggatttatagacagtatcggattgtcttggacgtgattggcttctctgcagataatatctcaacctcctacaacatgtgactatgctgaaccacaaggcgctacagaggtgtctgtctctaccccacagtcacggctgaagtcccaattcacggcgcgttaaagaggttttggtttgggagcttgacccgagcggcttcctctttctgtctccgcagcaaccatggctgtagtctgtcgcagtctaaatttcagatgtgcagatccagctatgtgaaatgacgacactctcgcacagagggaaaatggaaggaccccatttgggtctcaagggggcgtattccagcgtcccaggagtacgacaggagtacacggtagaaaacacgaaaccaagctcgtggcgtcttttactaataatagaagcgtaaggttaaaatagcgagtgttgttgtgacgtcataattcacgtgagccggagggagacgatagatgtagcttattaaagtgacgtcaatttggaagcacattcaccctcattcttagccgactccctacttgtaggtgactttttgggccatgtttagtgatgtgaaaagacggaagtcctaatgcggaataccgtggaaaacaatctaaacgtcctgcaccgattatatgcacttaaccgacttggcgcaaatgcactgttcaacggcatcgtgagaaaatgggacagaatgtgagagtgctctgaaaaactggtgcttgacagctgatcattcatctcatagtattacggaaacgggaaatcgacgatctctacacactcccagcagacattccaaacgcccaaaagttagaaagaaagggtggtgtgcactctctaagggcttctagctatataattccgtcgttttaccggtaagacgcatgggagggttataaatattttcacgattgtggggtaagtctaccagatccatttcgatcgagccattttcccaaactagatgcgctcccgctctgaaacactcatcggatgggtacatacatgattgactggcggggtatataccgttgagacccttgctgtgaacttctccgtaacagtaccaccgcggccggttgagtttgctgtacaccgaacctggtcgtctacatttgactctttctttaacttgcaaatcatacgaccgtgtttacatgaccggacagagagaaggcagcacactcttgggtctgtgcattggaacacatgcatttcgcgttgccccataaacaagtccgtgaatcacctacgagttattttacaccggcttgcttttccctgctgctgcggcagctgcagtggcactaaaagttaccgtttaatttactgaaactggacagttccaacagaagggctgaatactgtaaacacgccccgcaccactacgagtatgtacatacaacctaatggagcaaagactaacgcctaaatcacatgcttgtacaagtacgagtactcgtagagattctagtagttccacggtcagttgcaatctttcagactattatctcatccatgacgtatcagtacacacggtccagagatatctccgacccgacaaggttgccgtccttgcatatttttgtcgttccaccttggaacgcggcctccgtaaccctatgctccatacaattgtccctatacagaggtggtgagaactgagaggcaaactgacctttagatgacgtcatggaggtgtgcttaaagggcacggcactgatgtgtggggttaggcgcccagtgtggctaactagaagtccatctcaaacgcgacattacgaacatgacaaaaaacaacaacacaggctcagtaaaagtccctcaaatacacccccacttccaactgtctcagcttcacggattattcatggaggtagcagggcccaatgcgtcagcgtttcagctgctagcatcataaaggtaatactttccgtctattcttccttgaacaaagacagaaacatgagcctattactacttgtacaagggtcacagtcggcacaagatgttccgggcaaccatgacgtttacgtttgtctcttcccattacaaaattttccaacaagcttcgtcaacaggcttagttgcctacctcaaccataggagtagagttacagaaatacattcctagattttccgaagcggcacggaaaaagacggcaaaaacgaagcaaccgacggtggttgatcggtcacgtgattcagaacattccagcaagcgtacactagttctggaccgagaggtcatgtgatgatgagcaccaagagaaaagacaacacaagccatacaagtagttttcatgtggatctcattgcgtggagggcgtctcagattaccatgctatcgatgctctggtcatgttgcagcaatttgctatctgcaagagggctacttatatgttactgttatatattaactagttaaagggcctgatgagacctcgtgtgttgtttacaactgtttctgagattctgtgtagtgtgcatactcaatgggaacgttgaagccttttttcacctcgggaatggagatgagcttgttgagccacttttcgagaagcgggaagtcaccagcaagatcaatctccagagggccagatcgctggacccaacccacaagagagatatccgcgatagagatgtgatctccaaccaggaaaccggttccgttccgctccagtcgggtgttaagaactccgtagagtcttttggtctcattagtgtatcgggtcactccgtattcaatcttctcaggagcggcgaatcggaaatggtttgcctggccctgcataggtccgacgcctgcgttttggaagaagagccattccagagtcttgaagtactccacagatccctggggatacgaaattttttgcttcttgtcgtacttttcagccagatactggagaatggctcctgactcgaacagagcaaagggttctcctgaatcagtaccaggcccctcggtatccgtgattgcagggattcttccattgagcgacacctttcgaaactcgggagtgtgttgttcaccattcttgatgtccacagtctcgactttgtagggcagtccaagcagctccagagcgatggatatcttgtgtccgttgggagtgggaaaagtgtagagggtgatggccatagtggttgcggtcaattgatgtgaatggtaccaggtcagttgctgaggtaacaggatgggcttcagggtctagaagaatttaatccatcatttagccaccatttgcttatatataccgacatattccctgtggcttagacttccatttcgtctgatcccctcagatggcatcactgcatttgtcagctcacacacgataactttataagcgaagagtggggtcagccacagttgtggggactacgaaaaaaatggtagtaagagtaaggaaagaagagaaaattttaagggatgcactttactggtacctcaccaatgtcttgttgacatatgagaaacaccattgtgaagacatggagcggttgcgctgactgagtgagtgcgatagttgttattagtggtgttattagtgatgcatcggggtgtacaccgaaagcactcaataccagcgtgactctccaacaaagcagtcaatgcgcctcatttaatttccgagcctggactgtggcgtctccacttcatgttcatttgcaacttgtaggatatcaaccatagtgtcggcgttaacaccaagagaccggctgtccatcagagtttcctctgacttcaccctatccaggcatagttcaccatctttcgggtcccaatggatgtgtttactcaaaactgtcataataatcaagttcggtcgattctgaacgaatccattcactttcattgcgcgctggggtttgccaccctaacactcacatatccattagactccttggtccgtgtttcaagacgggtgaaatgggtggattatgtcgtcggtggcagtgtggagggttaggggagaacgcccgaaggcgctcccatttgtaaccctcgtctcgctatcgatgactcggcgtcggcagtacaccgcgaaatggctgcttcgatacgtagaatatatggctggcgtgacatcttcttcggatgataagtcaggttgtcattcgcctctcctagaccttcttccaataccctagttactctaagccttcaaacaatctactgtattcaatactccattgaagaaccacccaaacgtgaaccactgatttcgccgtcgacactgaaacagctccttctgttcttcaagccgcacgtccaaaattgagccactcaatccgaaagtcccatgtattgcttatatagtatttcaattattgtatgctcagattataccatcatattgctgagaggaaggtccccacaaacagcagtcgttgtgtctgacctatttgaaaccttatgcatagggtcttaaaaaaacgactgtgatttcgggccgacgagattgtattagagcaccaaacttacaggtactatatcttcgcccccaaaattacaatattttctgatacttttgttccattttgttgccattcttcctctgagaagggatagggatttccatcaattatttctaccaccccattactagaactctaacccaatccaaccacatccgtaaaattgaaacgctttctaaagctggtaatatattgaaatggaaaccaaaaaagttgtaaatctaggaagggagaatatagttacattttttagcaaataatatacacttcaactgacaaatggacacgtcaatgaacatttttttttctcccagtatgttcagtgcacatcagacatgcttgtcaaacctgcaagcttaatgcttaatcccagtcttccacctctgaaaaatatataaacccccttgccatccacttttgtaacgtcaattcgagactcctaccatgacttagctagagttttctcgagctgccaagttgcatcagtgcacctcccttcatgaatctatgggacagagctatgacttgcaaatacttacgcgctccgtttctcagatgggtcgcaacgaggggtgaaacaaccagcatgagctacagtttggggtctgctttactaaatggtcctgtcgcagggtcatattccagaagctgccgaatgggggcttaaaagcacctgctatgacacaactgttgagaccgaaaaaaacccctgcgatgtggagcctttctgggggtgaagaaacaggcataagtcagtagctaagacgtggagggagtgcaagcaaagccaccgagtgaaaagaaacccctcagtacaagcattaggacgcaggatgttgacgagaaaagcctagctcgccttctgaaggtctgtctccttgaaacagctattacgggcacaaaacattgtccatgagtttgcaatgatggacaatagacgcccagagctctacactagatggctgcagcagtcgaagagacttcgatatgttaagctacgccagcaccaatgggactgtgaaatgatgacacgaaagcaaagatgagactgtgaactgcgagagcagaatggcagcacgtctcgggccagagcagtcagtaagagttagaattagggccagagccattgagccagtgagtgccattgagccagtaaaagctagtgcgattgtaatacagtacaagtactcggacataccgaaatatccacaaatatgtatcttggcctttatcgttaatggtctatgactgatcatagggtcattaactatagccacatcttaggggagttagtgttaagaacaatcaagctctaacagtaaaaatagctcgtataaccagtgctagtgtatccaactccaactaccactaaataatcctcgtacctgactctacgcggctgtgtttcattttaaagcttggccgcatatacttttctttgttgttgagtttctttgtacgtttaacactgttttaggctaaacccgcgaccctgattatccgcatcatagcgtctcaaacgcaacgctgacaaccaagaagatacagagaaactgttagcatggttataagtatgtgtcaatcgctgagcagcccactgccggaatctaacacattatacacatataccctttcccatggacacagccttcgcccaacttctgaattatgtgtcagggggacgatggtttccctaccccgagcagcgtgcagggtttgaggttccagctcaattctggaacgaaccagaacctgaacaacaagagattggatacgaagatgcgttcaacggtattgatttggaggaaaacagagacattcacaacactactcctttagatgcctcagccgcttcaacgattgaaaaaaggggacacactccagacgcagagagcctttccgacgacctggttgtgggatggtatggccctgacgatccagataacccccaaaactggtcaactttaaagaagacaacaagcgcagcccaggtcctcattcttaccttctctgtctatgtcggatcatcaatctatacaccaggactccctgagattatggaggatttcaatatttcagagactgcagcactagttccaatgacagtctttgtctttggatacggacttggacctgtcgtcttctcccctctatccgaacaccctgttgttggccggctatggatctacgtcatcacgctggctatcttcgtcattttgcaggtccctacagcactcagtaaggatattggttcgttgatcgtgctacgcttccttggtggcatcttttcatcgcccgctctggctatatctggagctacctttggggacatttacgagatcgcatacattcccttcgctctggcattctgggccattgccggaatttgtggacctgtttttggacccgttattggaagtatatttgctcagcttctgaactggagatggacattctgggtgctgacaatgatttcgggtctgtgtctcgctgttctgtttttcttcttccctgagacctctgcaggaaacattctctacagacgagctagacgactggagaagctgacaggcaaggagtatacaacggctgcacgacaagaatgggctgccaagaagatgacgacagtggcgtacgatattctgctcagaccaatcctcatcaccttcactgagccaattgtctttgctctgggtctgtacattgcattgctctactccaccctctacagctggttcgaggctttccccatcgtcttcagtcaaactcacggtttcaacaccattgaatctggtctagcatacctcggtcttatcgtgggaggtgttattggggtgggattgtaccttcctatcatctacagcaagttcacccgtccagtgctgaagggtaactttcctccggtagccatgttcatgaaactgtgtttgattggatcctcaatcttcccagcatccctgttcttcttcgcctggacgtctaacaagtctatccactggattgttcccattattgcgtctggtttgtgcatcataggcatggtgttcatcttccagactgtcttcaactacttgtcaggctcttaccccaagtatattgcctctgtcttcgctggaaacagcgtcttcagagcgtttgttgctggagccttccctctattcacacatcagatgtttgatgcaatgggccctgagagtttccctgttggatggggaaccacactgataggcttcgttggaattctgatgggtgctatccccctggtgctcataaaatggggtgacaagttgaagggctcttctcgatgggcctaaacacacattaatatatagaactcagtaataaatagaatgatagaaattcataccttgcttcgacctatgagtcatttaacccccacatcggactatttcgggttttaaagaagagcttatgacaatcgtgctcgcgggttcctcttattcttcccctacaccagataaacaatacatatcaacaatcttaaacattgcaaaaaacttggttgccgtttcaggctggaccatcaagggctgctgataaacgaagaagctgcaatcggtgggacgtaaaatcgtgtgttgggtggctggggtgactgtgtgtctcggtgacgtggtttcgtgttgtctatgtgactgcgtggtccatatgacggtttatcttttcgacgagggcttggatgacttgttcgggtgtatggggcgtgggatcggtgcgactggttgtcagagcgacgggtagtcagggtggaggaaagaccggcactgtgtattatacaatacttctcagcggttcttcgccagttaaaatatgtaggcctttccaatattaccaactaataagttgtattaatctatacagtgcaaataaattatggcttcccttctagtactttcctcgggagaagaatcgctgccagaaagtaggcatgggagcagtgtcgggagactcctcgcgctgcttggcaagagccttccggactcgcacctctcggaggaagagcaggcaaatggccgagaagatgaaggcaaaggcggcaaaaacctgggtccacacaaagggcttggtggggttatttcgtcggatcttcagagcaatgacttcggagaagaaagcagggatggagaagactgtgaagatcataccggcgagggtaggcagcaactggagacctccaacttcggcaccaatgggtccaacagcaacccagacggttccaacaatgagaccgttgaagacggcgtagaagatgtacacaccgtaagaggtggcgggcagccagatacacaggtcgaagatgacaatgagagctgcggcaaccaaagtcatgttgattcggccaaacttatcggacaggtatcccaccagaggtcgaccaattgccatggaaccagacataatggcggaaatgttggtagcctggtcgttggtaaggccaatagccagaccggaagcagagacggagtagagcatgacaatgtaaccagcgagagagaagaagccccaggcgaagatgagagcacattcgtagtggaagaagagcttgtagttgaagcaggggaacttcatcttgaagccggggtttggctctcggattagaatggcggcacaggtgttgatgacaaaggtcatgataccagtagctcggaatgcccactccaggccccagatgttgatccatcgctgggtggtcagaatgaaaagcactcctccaacaccggatccagcaacagacaggccattagcgagagatcgcttcttgaggaaccacatgggcacaatgttgatggtgggaacaaacagaacacagagggagagaccctggagcagaccctgggacaagtaaaggtgccagatctcctttgcgaaagaggcagaaatctgagatccggtctgcatgcaagctccaatgaatagaagaattcgaaggtcaacgtactgggtcaccttaatgtaaaggggagcaaagaggaaaccggttccaagagccaacccaccaacaaaggcataatcagtggcagtagctccggcaaacgtctggtatcgcaagtaatgggccaggaacacggcaaaggacgagtttacaccccaagaggtggcgttgatggccagggcacagcccacagacacccatccgtagcctccatcaggaggaggtcggaagccgggaggaaagggagagggaggagcagcaggcttctcctcgacgtcctcgggacccttctcggggaacttctcggacatgacggacatgactcggtcaagctggttgctaatggtgggcagaaccacatcatcgtccacaacgtctccgctgaagacgacctcgtgtttgtctccgacggacttgacggagattcctgcaattgaagaagaggaactcattgttgtttgtgagcaggttacggacttctcaagagagcagattttctacatatataagcaatcaggcgttttgtgagaaagctgctggagtacttgaatctgtgcatcggtgttaaggtcttcagggcctaatggacattgggtttttgaaacttcgcatagagttgtgagcggctaaaatgggtgttttggcagagcccctaagtcagactagtatagagataggggggagattccagaggctaatgggggtaaaatttgtctgtgaataatctgagctctttttttccagaattttccttctctatcacagctctcacacaccctattacccctacatataacgtgttatttagactgcagagcttatcttgagcctcggcacattcgcctcgttggcttgttttgttgagtcacggatgtcggacccggactttgttaatctccgactgttcaaaaaccgacaaaatctgtcatgtcaaggctccgcccactacactgagtatttctgtgggtgagcaccgtcttacaaatccttctaatgcggcttctgcttgggtgcggctaacaaccttgagggcagatttgtggactcagtttggcagacggaaaaacggaagcttgacgcaactgcgtttttcaacgaagacacagatatcagtgaatacttctctgcctatgcgtgtggcatgtctgccaatacatggtgcagggccatacgcacgcacaaatgtggcaaccatggcgtgaatttttgttcccgtcccccctttccgtcctccctctctctctggccccgtgatcgccgtgaactctggggtttgcttcatactttttggtgctatgatagtctgtttctgggaggcgttttggtgctcggttatgcaacgcttttaacggctgtaaccgatggaaggggggggggggggttgattactgtacgagtacagtataaaccttgcaatcagtgtgcacgctcatagaagggcgtgagccagtctcgcaattgttgggtgcatggcgtgcgcggcttacaaatgaaaaaataaatcaagaacgcccagctcgtatcgcttataatgtatcggttttaagaactcgcttttagctgacaaatataatattctctatgacaagaacccatcgactttgtgacgcaaaaaggcaatgtgtggaggtcccgttctgcaacagcctcccaaaatcgaaaccgaggtctgccaatctgacaacgtagctgcctctaaaaacgaactgtcgcaattgccactccacgtcttggtggccccatcgtatacttctccggagttcggatacacaatcagttggagagatgtgtgctgttgcagtatgtcgagggacagcttggcaaccgtctccgcacagcaattgacgcctaggtgcgtaaaagaaggacaagaggccgcaagttcggcgatgttggaaagctccgatccatctgcaagggcaactctgtcataatctgcagattttacacttagagaaaggcacacgggtatgggggaaggcgggaggatggtgttcagaacgtcaaccagtacctctacttcaataatggacgggattgtctcaatcagaagcatgtctggacttccacccaagacagctcgaatcttgaactcgtgatgccgtctgatgtcgtccttggtgtatcccgtatagtctccattgtactcctggccccctccaagccatgctccaaaggggcctactgaggctgctaggagtacttttcttttgaccttagcttcagtgactgcctttcgcaccaactgctcgctctttctcagcatccacaatgcttcaggccagcgctgaactgcccctgccttgattgtgccctccagagatgcctgataggacgccgaagtgactatatccgcgccagccactacgtagtctttgtgaatccgatagagcaggtttgaattatcctgggaactttccagccactcagggtgctcgtcgagggctctgtttaccttctcaagctgatccactgtccatggatcggcgctttcgatacatttgaggaaatcggagttgataggaagcaagaacttggctgaccagagtgttagccatagcggatcggagcaatcgatgccacgattctccagttccgttcccatacctccatcaagaatcaacatttggtgtgatgcgagagagtgtagagttcatggaacatcgctctaaaaggaggctggcttcagggtactggaagcgtgcaaaagtgcggggagtagtataagtcttgtaacggcaagatatggaatataggatatacagtaattccagaaaacagcgtacctttttgaattactttttcgttaaaaaacactcacgtgaccaaacaaaggtcgaggtttacaacccactcttatgcatcacatgcactatcagtgtatagctggagtttatcgccttgaaatgttgtgggtgaaatacaagtcgcgcttctggagagtgtgaatttccagtaaggatgaaagtgagaacctctgtcattttttttgatgtaactcagtcgctctatacctatacccagcccaaaggctgtggagcaataaatgttcaaatcgagttacgtatggaacccgtcacttgaaaatagtccaaactttgccaaattgatattagagaacttctaccagattgctccagcgtcattcaaaatcactgtactaaagtactgtcgtaagttggcgaacgacttctacagctatagtatacttgttccaccttcgaatactcattgttcacaagatccacatacccttgcactgaactacagcaagacgaaaatcatactcataaccagtagcctgaggggtaaacaaaggcaaccagtatgtgttttcccttctcctctttctcctcatttcccgctctccttgatattgccttcaaacatctcaaaaatcaccccgtcttcaacaatccacatttggaacaattgaattacagcacccatagcggggtcttatatcgactcagagtgaacaatgtcagacaagaaagtgacatcggaaatacaagcaacatacttacaaatactccatattacaggtactggtactgaactgttattatacattgttatatattaattactctaagaaaatatgcaaggaagtaccaaaggagtacgggtaccacggaagaggaagatgtgagatggggacttgtggagtcgatacaactccagaaaatgcagggtatataaattagtgcgcggtgagagtggggtatggtactaggaggctcttcgtcacctcttgatcttcttggcactcataatacccgacttgatctgattgagatcgtccttggcatcctccgtcttgagcggagtgactccctgataacttctcgagtgtctgctcgacccatggcctccctgaccacgtccaggtctctcgctctcttctcccttgaacagaagaccctccagtcctccgtctcggtccgaaaaggcattgtcttcggatggaatgccgccactcctgtagccgtcgttctcggtagttccccctcgtcggcgcttggatgagcctgattctcgtccagacattgcgctgtcatcgtagtcgtttgtgtgcgtgattctggatcgtcggacaggacgtctctcgaagtcgcctgcagacaaaaatggcgacgagcctcggtcatcgagagacatctcatttgtgtatgaggaccggtttcccgctccggataaaagcaacatgttgtcgttagcaatgtccagaacagcacgatcctcccgaagccgttttcgctgcaaggtgattcgcgacatgagccgctcctgcaccattttgaccatacgggtgtagtcttcctcggccacggccacctccgcgtcgtactcgctattgacgctgtcgagctggtactgctcccacagcttgagctgcacgagacccttatctcgggtctcctcaaggtccacgagtttctccaggaagtccatgttgctgccggcgtgtagtgacgacagcgtgttttgcagcgttcgcagcatatcgcggtagtgtctatcccggtccgactcaaacatgtcagagatgtgaccgagcctgtacgctatgctttgtcgtcgcttatcttttttggcgagcattgtgagtgagagtgtgacggtggagagtccagggtggcgttgttgtaagtatgtggcgtgtgtggacgatgtttctgttccggcgtgtctgttctgtgctagtggcttgtgttgtcactcttgccacaggtggtgtgtaaaaatagggcgatttgttgctgggtctagatggttcagtgcagcttactcaatgacggacaggcagagtaatcacctcggactggcttctttcgcgtgctcgagttgggcgtcaagacacggctttctctggtggtgagtacaagtgcaagatgggacagcgtcggcaaaaggtcagtctttttctcgtgcataattctgcatgcgaggtggggggagcaggagcgtccattttatgggctgggtagacgccctaggggcaaacggtcggagaggagcgtttgcgggcctgtggcgagctcatttccgcaccatttgttttgctggaatattccatcaggttatgagttggagtatggtgggattttgagcccgcaaaaccgtacgaggcggattcgaactcagatccgttggcatttgttgagagggagagagagtgggagagtgcaagtcagggtaaatgggaactggctagataagggcatgataggctgagactcgagactaaaagcacggaggaaagggaaaacggtcatgtgactttttcggacttgagaaacttgtcggacctgacgaaaaggaaagaacaagaggcatgaggggttaaaaggtggagttggagaagtcaggcgtgtagttagcaatagtcatgtgtttattctgttgtaactgggcatggtggctcgttcagaacctctcgtggtatcgcattgtgcagatacaataataacgagtccagggtgaatcagcgtacgagtgtaaccagcacaagtatcgcactgtaccgtcacggggctgaggacgaggaaggcgaagacaacgtcgcagcaggtccgtacaccccgcacatactcactcacacgactcttcctcccaccatcatgtgacctggaggtcatcagggttgcttcagaaacctacttgtacatataataatagcgtctcatgactcaatggatggtgtaatgatgtgactacaactgataaaacggtgacataccctaagggccaacggttactccttcaccgtcaccatactggccaatcacatatatgaaaataccattacgcgccaagagaaagaaccttgaatacccccagactgcgagttgctcgttatgaacggcggttatgaacgttgaatcggaaaaaaggcagacaacaaagcttgatggtcgcgaaactcggccgtttgaaaacgctagagttccacacaagagagactccaatagttcgcaaatcgacgacactggcgcgctacgaaacgcctcgcttgtcccacagtgacccaaattctctcggtacccctatcaaaccctacacgtcggtgtccgacttgcatgagtccacatcgttagcgtaagagatgaaagtatcgatgcacgtggtacagtagtccaggatcaagtacggctgacaaggaacttatttagcgagttgccaagatatttttgtgtcagtctgaaaaagataggtatatataagtaggggcgcattacaacagctgaacacgttcgaaacacgcccacagctgccatctgaccgcacagctgatacacgttccagtctaaaactattcactcagagtctgtctgcatttagctaccccacagcttcgtgttatatatacgcttgagacatcgcattttactgcgcagtcaagatacgcagacgtgatctttgactatcaagatcaccaaacgcgaagacagcagtgatacaacaccagccactaccaaacaacacttccagtttcactcccactcacacgcactcactacaaatgagcacttgggaatcattccgggccacaggtctggcgtcggtggagtcctccgtctcggtcattgccattctgggctttggatactactgtcgaacgaaaaacattgtgaccgactccggcgaggcctttgtctctaagctcagcacacacattttcctgccctgtcttctaatcaccgaaatgggccctcacatgaccattgagagtatcactcaatactggcctctacttctggcccccatgctggtgttaatgctcacctacttcattggaaacaatattggacacaagctccttggtttccccaagtacattactgctggagtcatgttcaacaacaccacttctctgcctctgctcatgctgaaggcccttggaactacaggcgcccttgatgttctcatccccgagggagggaagctggaggacgttgtaaagaaggcaagtgcctatgttttgcttgtttctatcgttcatacgattgctcgattttctctgggccctatcatcatgggccagaaggaggagaagtttgagggagagaccactcctctgcttggaggaacagccggccgtctcgagcagaatgttgagaccttctacgagcgacacatttccaagtacatcaacgccgctgtcattggaggtctgatcgccatcttcatcggaatcattcctcctctcaagtggtttatcttcgacttcacccccatgaaagcttctctgactcaggccgtgacagatctcggagagctttaccctgccctccagctgtttgtgctcggtgccaagctcaccgctaagccgagtgtgcccgtcaagccctcctacatggttttcatcttctgtactcgattcattcttgtgcccattatcgccatctcatccgtcttctacctccgacaggccaacgagaatgtgtggaccagagaccccattctggacttcattctgatgatgacaccagctggccctcctgccatcactctggccgctgttgctgagcttggtggagttggagaggatgagctggcctcaattgcacaaatgctgctgtggtcttacgccatcactccattcattgcccctacggtcgctgttgccatccaagtcgtcaagggcgagtatggcctttaaaattagaataagaatggaattatagaatataccttgccatgctggagaggagtgtattaatatttgtgattagtcatatgaactacgtgttgcccaaatcgcatgatgaaatttgatgagcgctacacaagccaactgttttatggggggttgattcgaatcaggacttcatatctccacattgtaggagtaatctacgattcttaagcatgacaagcgactcgatatctgaaagatcagttaaatcttttccatttcgatgttgactctatgatactgtatattttactctattcgtttatcatgacgtttactgtatgttctggtgttgcttgcagttgagagcgagaaatatatgatatttgatatttgatgccacattaagaaaagatggatgttttaaattattttgcaaccaggggattattaatggctcagcacgtttttctattcccgtctgatcctctataagctattcaggtggctcctgtaagtcagttgaacaatgcagacacagctcgtattcgttagacctctcaggtactgacggtacagcatctacatacatataccaaggcatagcacatggaacggttttggaatacgaacaaagacggcccgaatcaaacgtggagtgaaatctgtctcacaataattacttttgattgcattttcagttgcaaagctcgtaaaagaagtcgaggaagcagggcacaacaatgctgtttgaaatgcgtcaaattttgacagctttgtgagcttgttgtctgaggttcctgttacgctcacttttttcagatggccacacttactatggctaccgattacataagcaatctcgcgtcgagcatacaatggcatagttgttgggaattaccaccctatcttgcatcctatctggtgcacccccgtggacctgcctggagttaatcgtcaggccacgcaaaaattgcttgtttctgtcatttcttcttctgggtgtgcgctgcaagatagccagacttacattgcatgcgctagaccaaattggagacccactacaatactgtcaccggattgatcgaagctgcgtgtatccgtttatacgagttttgtacgttcctaccgtcggcatcttcgtgcttgtatttgtgagacacggttataatttaggcgataatatttccactgataatattcagaactcccctttgtctttcacactgagtttgatgacggcactaattacagtacggtcgaagtactaccatatggtcgtcgagcatcccagtagcagctggacacagaatgacttgctagtccaataatgattgatttcatttctccatcgaccataaatggtgcgaaatctccgctctacacgggacccagaagcaactgacgaaagtagtcagttctcgtcacttatgcagcagaggatgcttggaagcagcgaaacaaagggtaatacatggaataactggcccgcggcctggggagctgcagagaatccacaatcgaagtcgtcgacattcattacatatcccatttgggattgatttcctgtcgggacatgtgagtccaacccaatgcatatggctggctgtgatcggcagtagtccagggacaaagaaaacagctatagccagctttgagacgctgcagaggtaaaaacatggtgacgaatacacgatacgtcgtagctatgatgatctgcggatatgcatttagcttgggcatcaatgggtcctttgagagaccttttgtgacgggtcacgaagtttcctgctgacaataaagtcgtatctatcgttgagctcaacaatgacggcccatgtcgtagtagctttacacgagattccccggtggaccaggtacctgcttgtcactacctgtgtgcgtgtaaatatactgtaacactgttcattcacatgtttctaccaggacttccctgcgcgtcgagatatgcacagacactcgtatagctcacgtagcatggaatcgagcgctaagttttcttagcatccaggagtcaatcgggggtgaggacccatagtgaaggcaccatcggtacatacttgtagtagactatcagtacggcttctgtacactctacaggtggcttgaagtagcgattttcgcaggattgacattgccatcaaagtcggagcgtaggctcacaaccacttagactgccttttatggattagctctgagagcatggaacgagccggctgccatgtttgcatcccgacccagacaatggctcaatgatcttcacagaactatggctggggcatgtgtactccgtgtgaagaccccaaagagttctctaccccttcatctgtaacagtccaatgtgatctatctgtgttcttcctctctactattctttcagggttctcagttatcaccatcgcattgatcacaggattgatagagagaaagagggagagagaccaacaacttttattccacgaagagcccttcacgactgtggtagagtttggagtaatcaattaaggtaacaggcttttgttccatgtcggaagagcatgacaagtacaacgaccatgcttagggatgagacatctgtaaatgggttccagctgtccaaaagaggaaggtggcgagaattttcgttggttgggcgacaggggagtgtctttttcgaacggtctactgctacttgtagtacagtcgaccgttggtaaccatggatggttctaatgtttttagacggcttgtagtcgtttcttagacctaagatttctcagatgagctagacgttcatttttttgggctggttgccttccaaccaccgtcccaacttactaaaagtagactgccttatataatagggtcagcattgcactttacgtcaccgcgacctgaatgatgggcgctgcacgattgcacatgtgcctctgaacaatgtatgccagccatgtcagatcccccttttgcataagcgtgtgtggaggtggaggagcagaagaggatcgagggaggatgtggccagagaactcgcggtcgactatgcgacagggacccttcggctaatagacgggttttatgactgcagtagctgcagcaccctacggcgactcgttatatcgtcctggtggcgctttagcgcgattagagagctgcaaaacaatgctagtttttggtcccagtggccctcagtccaagcctctcggtaacacgagtaccagtctctgcttgatatcagaatgcacgaaggaaagttgtcttcgttcttctagacactcagatcagggacagtttgaccccatcaaacttttggatgcaagcagccatgtgacgaataaatgtgacaatcggagcctgtagctctgtgaaaaacgtggattaggtcccttagctcgaagacgaaacagtgctatactggccgctcagggactctctaagcgccccaggcagacacgtcagtggtctactggacctggtggcagcgtcgtttattactttttcgcactacttgtggccaagacgctaatctgtcgccgtaggtttttcgatattgacgtccacgtttggtttttgattttgatttttcggtctccaaaataaaatttgagcaggcagggagagagaaagagccaagcccaaaaagcaaattattaggttccagatcaaagagaggttggctttctaggttttggtaactgcgcttgttgtcgatcatcgttaatacaagtccttatatgtgggaccccggtagtctttagaataattttttttttggtacctccgccctttctccagacaagtcatctctacagctcgctcgcaccacgcacagcacgttctgcacctgccccgccctgttgcagctcaaaacgcccacgttccctaaacatacaccaattgtgtaccctccttgcttcgctcacgcgtgtctaataaggggtaactttgacctacactctcactaccgctgtccagctccgtcacagcccacttgactaaaagcaacatctctgcttgcacatatacagtacccctacttaaccccttagatctgcagtatatcatctcagacgaccccggaacctccccctgaaccgatattatcctacgctcccccctaaatctgcaccccaccaaatcaccacaaacaactactaccgcctataatgctgtctcgaactccccgaccagacaccaagcacaagcgaaagtcgtcactactggatctcttcggtctcggacaactcgcaaaggaagacccccaggtgcctgaaatctcagcacccatccccagctcgctacagcagttccatacgaccccccaggatctgcaaggcgagttcatcgatctcactctgggcgccaaacgagactcgtcacactttcacgctgaatgtgaaacgccgcccaaacggcgctcctactacgaccccaacacagaccagctttcgcccattcaaaacgtggacgccaacgacctcgtcaacgaaaccatctcgctgcgaaacagagactccagcagggactacactcacctgtcccactccgcgcaaccgtcactgtcggaatctctccacgactccgagtcacactgcatgtcagagtcgcaaccgcagacaccccatacagactacaacgacgaatttgaagacgacgacgctgccatcctacaagccgagtgcgtcgaattccatcaaccgcgattccagacaatgaacccggcgtccatgcactctgtctccaccattggagatgcctgtgtgcgagttggatgctcttctcccgccttctcggacgctgatccattcaagaagcgagagtcgatgctctccacctccactctggacagaaccccctcgaaaagaggcaacaaaaatgatctcatcgacagatacctcaactccctctacgatagtcaagatcacccttccatcgacgatgacatgaacatggacgttgacgaagatactactcgagtctactatcagcatcccgtgactcctccccagtccacgttcaacttccccacaagagattcctctctgccccaaaattcacctcgaaacgagttacaatctgcatcttcctgttattcttctaatgtgtctagcgcccaaaagtccgttcaggtggaagacgcctcgttcgctatgatcaacccttacgccaacggttcccggtcatcttctgcatctgtcaatgtggtacctcgatcccgagtggcctcttcaggcggagttaacagaaagcctgttcctgccagacaggaggagtccgtcatgggagaatttgagaacgagctggcccgtctggactccattggtaccttcactgagctgcctcctcctgtctcatacgccagttctatcatcagcgataagttgaccccccaccctgctcttgtcaatgctcgcaacactgctcctggaatgggttctcgaaacggctcacagcgagacatttcccgagatatggctggcatgtccattgcctcctcctcgacacagtcggtcaaccatgctgctcgaaacccccatattcagcagcactccactacaccttctgtttcttctgacaacagatccaaaagacattctctcagtggcaagtttggtaagcttaaggactttgggcgacgaattacacactccaagcctactgctcctgctcctactcccgctgtctcttctgctgcccctacccctcgacctggttctaacagatctgacaacagccgacgacgatccatgctgggcttgtttggctcttctggcgaagacaacaagaactcttctgcttcgcaccgacgaacctctactcttgctagcagccacatcaacgttgcccctgttattaacatgcggttcgagtctgaaaagcccgacattggacgaggattctagtgttaccttttgtttcactctataatttattgcatttctaccacccaactgtgaatgagtaggtacgagcgacaccgtacagtaggatacgtcgacagccactgtttcgatgtgagcaaacattgtagctattgttatcctcttgatagctgctcatttcgcaatttcccttcttggaagtgttggaagtgtgcacttactcgtaattagacactgcgataattatgtggcctgtgtgctggaaggaaatgacctgctcaagattattattggaggagatgataggtctcatacagcgtaatatttgttcgataatatcggaactgagctcggctaattttgtttcagctccaactaatctctcgagagactttttgcttacatgtcagcagtgctatgctcagatggtgccatacagtggggaggtccgagaggtacacacggtatagggaggaagcaagaggcaataaggcatgtagatggttagattttttgatagcataaacgaaatggaaacaaacgaaatacggcggccgatacggcgattaaatgtctcacaaatttttcagggtgtaaccgagtgaaatgagcttgagtggtcggtctggaagagacaagtatttccgtcctgtcctccagatgagttgttaatttctcttctataatacccgcctccctaatacgccctggcgatccaaccagcacgatctacgttgctttgttttagctctatcgaaagatttcggcggcagattagacacacgatttgagtgcgtggtaggagcactctgacaaggttccgtgactgctgcaccggagtgatacaggaagtgcaaagtgaagacgagaagagtctaccggttcgtggcggtagctgtcaaaaaatcacaaaaacatgggcgaaaatactcgcctgacttatgccacacacatcttcttgggtttaaatgggcgacgtaggcctcaacttgtctggagccgccgtaagatgcaacagcttcaacgcatgtctcacctgaaggcttctacatcgtactgggcaaggttttgagtggattagcggaacctgggtgagcatcttacatgttgacagggctgggtggaaacaagcgtttttgtttggctatcggcagcatttcccaatccggtaaattgacaagtatcagtgggtataacagtagttatgtacgattacttatgttggggaaacagggtcgtagaaggcccgttggggtgggtctgagcactttgcggatttctctttctcggttccttttgacagagttctggcagggtgcattcggcgcaccctggcgcagtcgagtgacgatctctgaatctacttactaattcggcaatgtaattgtgacagacgagtatgtaattatggtacagtaacatcaaatggaatgtcaatatttgtacaggtacgattacaagtaccgttactcatagttgtgtatgtagtgtactagttaccgctacatcatgatgtaagggtagtgtacatactactacgctgacataatcacacttgagcttacgattactgtgctgcagttcttgaataccatcccgtcctctgtatacagtgcatctcctcaattactagacaaataaataaagcgcattccctcgtctgttgctagatcccactcacctccttaggcactgctgcgccgacttcgactctccttttcactctcaggcatgatgaactccggctcctcaatgcctcgtcgtgctagctgataagccgaactgacccatctgtcgcctgtgttggtgccaaccagttgaaattggaagaacacgcccttgtacgccagctttttgagcaacttgtcgatcgccagaatgtactcttggttctccacaggataaccctgggtcgttttccagccgttctttttccattcctccaaatacaccgtcagacactccaacacatagaccgagtctgttctgatctcccacttggggtagtctcgtcgattccagacgattcgcaacgcctggtaaactgctgccagctcagccctctgggtcgtgtgcttggagccatgcaacggacccgaaaagttgcagatgttgggggctccaaaaacaatgccaatgccacccttggagttgacgtagccgttgttgtcacacacaccagacgtgtagagcacccggatcgggtttccgtacccgtccacagtgtgcaaacctcctccaagaggcgtcttcatgtatgcgtcggcctcctgctcatacatgaactctttggcgttggaatcgggatagttggtgagcatgaggacagccatgtttctgtccgtgtacactccgggcttgtggcccatgcgcacaacatagtgtggcgtggatggcggttgttctgtgatgccataattggggtcttcagcagtagttactggctgcatcgttgttcggagcacttgtgagtcgattgtgtaccctagtcgtcctggtcgtgtggccttatatgtagaggtgggtccctggctggcaaaaacctagatgacgcgcaactcaatgtctatataccgtgaaagatacaagatgtttttttgcgcatttcagatttcggctccaacagctcgcccgcaacaaaactgttgggaaagcctagcaaacctacccggataggcaggtgcggcttatcggcacatgcaccatgtagggcaaacttgctttcgataagacaaagccgaggtcgtcaagaaacgacgatcgtcacacacacaatcacgggctcgtggctatcatacactatccacacaccaagactgtagtacatccatactctagaccagcagttatcagctgcagattgggtgtctcatagctgctgatttagcctcgtgctaatacggcagtttttagaatactgtagccacgggcaaactctcagttggcggataaggcgtcatcgcgtgtggatccagctttcgcgtgcataaggacgatacgtccatttcatagatatacggcctgtgcaaaaaatgtggggtaaaaatgtactttggatgtagcgtactcgtgtgcaccaatacagcagttctttgttctatatgtttccagatcaggtcttttcgcttttctttatccaatatacagtagctacgacatgcaacacccatgtcatgtgagacagcggcgccgaacgttggatcagtgtctagtgaataatcctctactgtacatctcacccgtaacaattgccataccacccgtccagtcaaggcacttcccatagcatgtacttgtatcaataaccaaaactgcacggatatgcacccaaatacgccacggctatatccatacgacccccatccgactccctgcgcatccttcaccatgtatcccttgtgtccctctgcacatgccgttatcatacatatcccgtcagagggacataactgaacgtcgagtgagggctcctgttttcacaacagtaaaaaacggagatatgtcagttacggacgtggtaaatgtcgcccacactcgctcacacttccgttcctccgaaaacaactctctctctcttatgacgttttcaaagacccccacaaaacatcatgtgaaacacttcgaaacaaagaacttgttgagcagaagctggccgtgagacgctgtatcaccacgggctgtatggaaataaccaccacaaagttgggctgtactgagacccgttggctatcgtgtgttccagacctctctacgattgtagtgaagtgactcttccagatcgtctgtcacgactggccctttcaaattggatagtcccagtaagactagtacttgtaggtgggttccagaacaccccgcttggccaacttcatggccttgttgtagcccttctcattggtgttgcagacatgcttgaatgagaagatatcgccataaaaggtcttcataaagatccatcgattgatagagtaatagatatctgcattagcaaccagccgtccattgctgcccttccaatgcttgtttcgaatggcctccatctctgtcgtcacgctcttgaaggcttcaatgctgtggattcgaatctgccacttctccaggtcacttcgctggtagatgatctgcaacgcctggtaaatagccacaagctctgcacgtttctgactgatgccaatctcctccatggggcccgtatagttgcaggggttgttttctccaaaccaaatgcccattccacacatgtcctcctcatctcggtaagcacacacgtaaaccacgtaacgatgatgcccatcttcgtctacggtgtacaaaccgttccacgtcgggcgagattctctgtactcgtctgcttcgtcccaggtcgtgtgcacttctgggtgtgagtcggggtagttagaaaccgcattttgggcctccttcagctcagtaaaagtattggcacccttatggctgatcttgaccgtgtaatagggccccggatgaactcttctgctgtcggcccaaggcattttgtggtgtgatgtggtgtgtcaagatagtctgtgggaggtggaactcaatctgcgtgtgagacgcaggtgggggtaccaaaatggttagtagagtggggagtgtaggagggattggtttggaagaagaatttgggtataatttggtcgcgagccagtcaaatattctactctagcaggtctgggggcagtgggggacatttgaaatggttgataaacataccaatgattcacagagacagcatccagatactgatgatgacagcgtattcaaaaggtggaacaatccgaaggtcaaatatgtgttatacacaacggcagtgtacgcagtacatttcttaatatggcattcaaaaattcgccagctaacaagaacagttcctctgagaaagcgggtacatcactcggcacttccaataacaaatttgtgtgaataatccgaacattacaccattcttcattcaattcttcattcactcagcctacagtagctacagaatttacttgttcttgttcattagaatttgttactgaatctatggaaacattttaaagaagaagggcggcaacaccaaccagggcggcaccaagggaaacaacggcagcttcagcaccgttcttgttgtgggaaacagagcccttggcagcagctacaccggcagatccggaggccttagcgccagtagcagtgccattgtggcctgcagttgagttgctggcgacagaggagttgccagacttgaccagatcagcaatggctggcagaatcttgttgccggaagtaccagtagcgttaatgagaggagtagggaagccaagagacttgtcggagaagtagccggggtaggaaaagttgttgtacagaccgtgctcggtgatgttgtggttggtgacagaagaaccaatcttgtcggcaacgaatttgaagacgttagcagtgacgtctcctcgtccaagatggggaagcccccagttagcttgaacagtagcaatgttagagtaatggttatagacggtgtcatcagtggtacccttgaggttctcggggatggcacctccaagcagaagagcaaaaactcggttctgctcggtgtatgtctctgtctcatcaaaggtcaggatgatgaggttgtctttcatgaagtcagtgttgttgaggaggggggacaggaagttgtaagaccaggttccagagacctcaatgtcggtatcgtgaccgtcgtttgtcatgttgggggtgatgaaggcccactgggggaggtccttgtcagccacatctttgtggaactcggtgaagttcttgaggttaccaagtcgctccggcttcttagtaaccgagtcgtacatgaccagggggttgtgctttcggacgtagtcgttggcgtagtcggtctgtcgagagtagttgaagccctggaagccggtgtagggctgatgctcctggtactcaccccacgagatggacttggagtcgagcaggtcggcaactgtgaagatctcctcgggaagagttcggtaaatgtcatcgaagataccaaagtagtctccaccgacagcagcaacatagtttggctcggaggggtgggtcagagcaaaatagttagtgagaaggataccctgcttggtcagagccttgaggccggcctggtcaaaggccttctggtagtcagtgttctccagccagatctgatggtatctgtcgaaagccttacccttaactgtcttcttggacttgaaagagttggaagtggcagtggcagcggcagccttgatctcagccagatcaggggtctgggaggggatcacgggagtgttggtgtacagagtcttggtgtttccagtgaaagcctgagtctgggtctctccgagaccgggagtgaagccagcagcggcgacagtggaggcgagagccagaacggtgagcttcattgtaggtatgaggagtgacacttggcgatgagatacggatcttggcgcattatgtaggtcttggcagtctttgtttgagtcggaaatgagcggtaaacaaggcctgtttgtagcgatagggtttttctacggaaccttggcctcgacagtttggtagcaagaggcctaggtggatgagtggttctgtaacttatgtgtagtttcttgcttccaaacgaatcaatcacgtccagctatttgcaggtatgttttcgcagccccccctcctccaggtatcggacagatcaacccctctacacgccacacgcgtgcggcacgaacccgaagactaacccaggcacagccaatgatcgtcgcttcattagatacgatgtaaaggttcatctccacgtgggaggaatctgtgttctcgctggccatcaagattgaaatgatacggtttgtacgatgaagcagttaccaacttacgcttggaacagactccacctatatgtaataggttcaagtagctatagagggaccttcgattataacgctgaggtgaccgtacattctacaacacgtggattggcaatcatacggggttgtttactagcacagagtatgcgggcccagagatacggaaggctctcgtgaggcacttccgcgggtgcagctgatgcgaataccaggtttggtaactgaagaagaacctgttatgtcgatggaagggggaaaacatgtgggtctgaaaggagggtcttggcacatccacaagggatcattaatgaaaaaaaaattgctttggtccggttgggggccactatggaaccaactaatagttatcatggtgcgccgttctggcagaaggttcacggttagtgcccgttggaagtgggcggtggaggagatgctcgcgtgacagagggcaagaggggatgagagcatggaaaactgtagacttcttcgaagtaggccagctcgaggacaactggagaggtatctgtcttgctacaggcgtcactggacatacactcctttcaatctactgtatgattaattatacctcgcgtcaagctgtactcaatttctatacgtccacagagttacgtctgagagaactacaaccaacggttaggttacagtgacttggacgtatcaagatggcggcagagttccgtgcagtaattacttattctcgaacaaccaaccacactgaagttcgaagacaggttgcgtgggggtgaagtcgactgagcagttccatggaatcttgaacgttcttgtacttttacgtgagacaagggttcttagagctattgcatttattaaacgggttctcagatgctatttcatgaccgattaatgcctgtgacttaataataagccggcttaaccgacatctggactccgtatctgtagctcatttcttgaccacctggagacaggcagtgatggtgactagctaaacaaaaaccgaaatatgcctccaaataacaagtccatgagttggttttagcaccaactgttctctcaactgacccggttattacggggtggcgtccaaagatagttgtttgtcttcttggcggagtagtgtggcttccgaacgccaacgacgttgtctttggaatgggaaatctcttggaccaaaataccgggtgaattcagttaaaatatgttacggcggcagctccttaaggaacagcgactccattcgggacagattcgtcttgaaactatcaagggtctttcagtcatgtcttaaaagcttaactagaagtaattatacatatcaactaggattgttagacatcgtcgacagtcagccttctggttcatttcaaaggttattctttcacagcaaagttataattaaatgaatgtatatgcagaaaaaaaaaaaaaaaggtatacagtacgcaggagttcaactagaaagaattagcaatcactgaaggagtatggagccattctgagtgttgatgatgaattctagccaagaatcttttcattgttaacttttgcaggggtcctgaatcccgtactagaatagaaatccctattagggttctgggtaggatgaggtgagaattctgatacatgcaaaatatttatcctctaaagagttggtctaccaaaaatgtacaattatggtatcataatgatgctctcaatcatcttatataacgagaaataatatcttgatttcatagccggacccactcataccctaatacaacttcctatttggaatgactcgatttaagcgcttcctgcggcgcagaaaagttttactttccacaatccacaatcttagcaaggctgaattagcaccgttgtggcgctaacaggtctgaggtctaatgaaagtgcaggagggggccatggaagatgaagcgacagggacgagcatctctctggggttgcattttacgtgggtctcatctgctcggagaattatatcaacgtttctgtgccgcttctgatcagacagcgacgttaaacgagctccgcaaatcaccggtatgtttctgtactattgcgctgacaagtccaaagagggttcgtttcagtagaaccattcttagatttcgggcgttacatgtttaatttagtctcgttgttgatacaaaccctgtcttgtgagacagttcgtagatatcatgtgtgatggatttggaatattctgagtccgagatcatgcagcatcatgaaaaattgtaggaggtgtgttttaccgtctttcaccattcttttgtaagcaagtccggtacaatacaatgcagtaaggtaattatacagtgcccgttgggctacaatgcctactaaccgcttagacctacaaacagacgctagcgaaacagaggggaacggaacagagacacagccctgagacaccacaagaacgaggggagatggaaagcataagggctcgaacctgagttcctgagtcacacgatctctatatggcgcattacaaatgatcttctccacactaacgaagttttaggtcctgttgttgctcagagacactaatgctggggttcaggtaatgacagtagtatgtacttgtagtagtttgagtgatataattactgttcttggaggcgcaagaaaccacaactgtttcaagtttggtattgagggctttcttgtgcccaggaataccctgggggataaaagtgacacatgcaatcatacgtcagataatgtgtatctggcatgtatctctgtctatatctcacttgttggacgttgtcaaaacccgaaaacctcaccacaaggcgacccacatgagggtccacctacattcgccttacatgaatggtcatcacaggtatgtacatgtctgatgtgcttgagaactgcgtcgcttagaaatgtgcgacaacggcgccattattgtgattcaacggttctactatccgcgccacgacacatcctgcccagcatcaccgtattctgcttcgaactcctttcaattgccgatattgccgtgtctcagaagtgccgtgtataatgtagatctctattttatggcccggtcagaaaccgtaacagaagcagtcgaccacctccgaatcttctgaagaagcttagaagaccatcattccacacgtagctacactacgagtacatgctgtacataccccaaacaagctaccccaaaatagctgtccttctagttgtgcatatccactaatagttgtatagcagtttccggaaaaatggagctgcatttcatttcgtttcatatcatttcatctcggctctgtccacatcttgtccttttcatttcctatggatcagataaagggttccggcctcgcctgccgttttgagttgcccaaacaaggtctttcaccaaagttcgactaagacaaagagaaaaatttgtccggcaggcacggaagcgcaggttacatgcatctccagaaggtgtggcttgaatgacgcaaacgtctacttcacgcctgcatcgcgtgacctggaccaaggggcctgtgtaattcgtttatagatgtgttctcttggcgtctggaacctcccgcccgattgaaatcgcttagaactacggggacaccctgctcacccatagctgcagcttccgcctaaattttcctttatttaacctcgtgaaaatcaaaactgaaaagcccccggtgaggctcggagtcagaaatgagccttgtcggagtcatgtgacttgtgctaatcgagggcctccgccaaactttacgcctctcgacaaagggaaatgagagtttagcggaaaaataacctatgcaacaaccgagctgaaaacgttatctgttctcagggcatctgtagtgcaacccatcatttttctcatatattgggcccattcgcgattatttcctcacgcgcattactctgggtctcgacgaattggtgtggcattttctcagtgaaattttccgcattcttttacccaaactcacccgtctataaccacgacaaactaaccacccttccgagcatccacagtttctacgactactcgtggcttggtggctttttttttcgtctgcttggcttttcattgaactctgaaaaacgattcacataaaaagggacagactctctctcagtccatttctccaaatacgcaaaccatgggtctcaacttcattaacaaattgaccaagtcagcgtcaccttcgtacgacgaaaaggagcgagaaaacgtctccgttaactctgccgatggtctcggtaccgagcctcgaattatggaggctggagacccccatggatccgactcctcaattctcaatctgggtaacggagaaatcattgacaagacctctgatgaccgaaagcagattggtgtcatgtctgctgtcttcctaattttcaaccgaatggttggaaccggtatcttcgccaccccctctactatctacctgctttctggatccgttggactcgccctcatcatgtgggttgttggagctctgattgctggagccggtctcatggtctacctcgagtggggtacaaccatccccaagaacggaggagagaagaactacctcgagtacgtctaccgaaaacccaagtttctaatcacagccatgttcgcttcctacgtgtttctgctcggatgggctgctcccaactccgttatcttcggagagtacattctgaacgccgctgaggttgaggtcacccgatggaaccagcgaggtatcggtcttggatgtctgtctttctgcttcctcatccactctatctccgtaaagtggggtctgcgactccagaacttcctcggtgtcttcaagctcattgtcattgctctgatcacaattgtcggctggattgccctgggaggaggtctcaagcacgtcaaggaccctcatgcaaacttccgaaatgcattctcaggctctgagaaggccactggatacggtattgtcatggctctctacaacgtcatctggtccttcattggatactccaacgccaactatgctctctccgaggccaagaacccggttcgaaccctcaagattgctggtcccctcgccctcatcatggttgccattttctacatgttctgtaacatctcctattttgccgtcgtcccccgggagcagattggtgagtccggacgaattttggctgccaccttcttccgagtggcttttaacgagtctgccgagaaggccatgtctgtctttgttgcactttctgccctgggtaacgttctttccgtcattttctcgcagggccgaattatccaggagcttggtcgagagggtgtactgcctttctcttctttctttgcttccaataagcccttcaactctcctttccccggtctgttcgagcactactgtgtctccattgtcattctgctggcccctcctcctggagacgcttacaacttcatttccaacttgatcacataccccctttcggccattaacgtggttgtgtccctgggtctgctttgggtccactttgacagatggcgacacgcccgaaaccccaacctgcctccttctatcttcgcagacttcaaccctcccatcaaggccactatccccgtcaccatcttcttcatgctggcgtctctttaccttgtggttgcccccttcctgtctcctgatgccgaccagtccgtctacaaggatctgccctactggctgcattgtgtggtgggaatcgctcttttcgctgctggtgccgtctactggctcttctgggccatcatcttccccaagctgtttaactacaagctggtgaagcagacagtcattggatccgacggttggtcaagaacggttatcacccgagtcaagaacggcgagattggtgagggcgaagagttctaaggacttgcctaaaccaaaacaaaacaaaacaaaaaaaaaactcccctaaaaaaaagactctccagtcagcatttgcataggtgtgaatccaacctcacactgtcattggtcctctgagttaaggtccatgaatgtcactcctaacaacttatttatttagttttgcttcaacagttaatgtgaacctgttcactggctttacccagtgtacaatgaaaaaaccacttgaaagatgtagactgtgtgtaatttgtataacctgtggcttacttaagctaaatttttgttaaaagaaaagagtgataatagttcaatgaattgttgcgccacagaaatattagtcgggacgatcgttgctgtcgacatgacgactttgatttgcaagtcaattatgaattcgtattgtgtttcggagtttcagaagttccacagatatacagtccatcgtattaagcgaaaccctagtcgagatagcattccagacagtttcacctcatttggacattttcacagttttgaaggggtgtggaggatcagcatatggaatggaagctctaattgtggggattcaggttatccagtttatatatactcgcaaaattgctatccagttgcccaggcttgagaagtagtaccttcaattgaccaaggctaggtatttgtacccgcgtctaatgatgacataactagtaaggggatatgggatgcttcagagatgctatcacccaacttctgactacttctgactacttctgactaccaaatccctgttttattagaagctatccatcctatctccgaccagaatggcaccatgaacatggttagagctgtactctcactcggacaaaactgtgcgcctgaatgcctctccctccgcttcaaaaagagagatttaacaagtgtggcaacagctttgcctgaaatgaacagacggcacttatcgataaccgaaattgccagtcatactcagagttacgttggtgtggcttgcgccgaggtagttaggattacaccttcactagtgccatgatgggcattcccttctcacataatcgaagtataacagatgtggcttgagatacaacatactcgatggcagacaacatccgagaaaacaacctgtcagtgcgttgaaggtggaaggagtttgcgtggaagttgagttagccattatgggccttgcgttatatcatagtttatcttcttggttaatggctcgctagagaacacataaggagtggtgattagtcgtacagactgttgatagtaggctgcagctttcagtggtgtctaaaccgtgtatgtgtgcgagtgacgctgccatggtctacacccaaacgccgcctcttctaggatggaacaccctagtaccgttgctaaagaagggaatacctgtttgaaccgttcgacaagacgatgttaggtttagctgcgaaaagctttggtcagagcagttgcccaatgcagtgcaacctgtaatatctgttgaacagccgattgactacaaggagatttcatatagatatggacttcgtgtatagcgggacggtattgcgggacggagtcacattaaaccagttgattgtgacgtcttaggctaattatagctcaaacagcatgcgattatcactgagtcgtgtctgacttacactgctttgtcatccgccttacagtcatccaaagtaggtggattttgacatgtactgtatatgaacaaaagtgatagagtgatagtttcctgaaagatttagacaacttctgtccaaccagcaaatgaatcgttaacgtgaacagtttgaggctgcgagactggcaggtaggtgtagacgagaaagtatcaccgcttgggcttcttgcggcagttccttctgtgacccccaggttaataactgattggctactaacccaacttcgaagcgttagcaccagcaacgtgacccttgcccatggccactgaagtcatcagtttcgtagagtgtgcgagggactactagtacaactttgttggttatcgtccaaagggaacgagaggaggagaacacactattgggactgctgttctttgagaaaccaagaaaaaataccagaattgtatcgaatagtttgtaattttcacccaagcacatctagatagttatcaaagccttcaagccaaaacacgagggtactggcgctcttcacggagttgagactgagatcatatggcccagacgagctgcagatttgattcgacagctccgggatcatgaaggtgtctaaaccgcactgctggcagaacgccctcagatacgataaaggaacacgactgaacgtccagtctgaacctccacaactcagccgtcccacacttgtgcatgcttacagtaacttcggaacagagatgccgaactagtagaacttgtactgtaggtagaattcatcatgtagaatgaattttacaagtgtgaattatgaagtcagaagtcataaaggaacagatgtattggcaacccattatctcatcgcttgtgaaacgtagtttgctcctctgcatgcttcagccctccatctatagcaaccgaaaacctctctctcaccacaaaccttagtccaatagaaacatgcggaacggcccgttacaagtcgtgcataaaacagtaataaaagtgaaaccggttaatattgtccgtctgccatgcatgttggacgtgtggttcagacgtgtggttcattgtttctgataagttcaagtacaagtacaagtatagggcaaggataatatctcgcacattttgagggcccctatttggcacgcgggcgtgtttagtatatgtggggagccctagtgtatgttgtgcgcaggtgtctgtaaccagactggggtcgatcacctaagaagacaaacactagcgactggtgagctcctgtagcgtgtgcggcacgtcgtgtttatcggaagacaacatgccaggcctcactacacccctcgccaagtaggcagtgctaccttatgtaccaatacctgtactgtcgttggggtgacgtgtatgcttgggtcacctccgtcccctcttggcaatgactgttgggcaataacaatggagacgaggatcttcgaaatcgacgtgaacagtaagataaagccagggtgatttaactcacgagaccctgtaacccggtggtgtccgtcagtggcggaacaaccagttccccgaatatgtttctggttccatggaacagtcaaccatcgtttgtcagcgctccgtgcacagctttgacagtctgtcacacagctcctggatgtgcatcgaagccccctccacctggtgccaccttatcaccaggtggagggcgaattagggcttggaaaatgtccatgctggctggattgggacgttggcaaggaaacagatacgagggatttctgtacaagtgacacagcggaggttttggagcgaaaaaaccaaacgttgcagctgggcgcccgctcacctcaaccgtcagatgtggtatatcaaaacaacgaccaaaaaaatttagctattatacaaccctgcaggaagggggcaaggtgttgataaaggaagttgtcccgggaggtgtagcaatgaatataatcgaatctggtggatttaaaataagttattcggccacgccaaatcgattaaatccgcctcaactagcagcaccccccagtaaacccctattcaacaacctacacgtctcgcttgttcatcatgcacaaggaggaaaatagacgcacgtctggcagctgtgttttcatcctctgtctttagtttttgataatcgtgccttctaaccaagagacccttggttttcacactagccgcgaaccccggcctcagacagcaaaaccacctgtttgtcttccccgcctgcgtggaaacctcccacacgtgatccacctctacaaaacgcgctaaccgggtgctgattcgaatcacaaatacgacccactagctagcactatcggcacactcgtcgcaccaccacaaaatcacaatgctacgacgcagatcttcagcatcatacccacaacagtcgctgcccaaaacacaggggacctggcagccgtccacaatgacgcagggagtgcggaccaaggcccggttctatctcagtcgcatgccgctcaaaatcctggctgttctcgcagcgctgctcatcacagccggctttgtgacattcaacttgcgccacccggccgagcaacaacccggcggaaacaagcagtacatcaaagagattgtgtttgagaacccagcactacatggaccctttgtggctggctgcagaccgatcgtagctaatcctgaagacaaggtcaacgcggcgtttgtcgtactggcccgaaaccaggaccaggagggcctactgtcgtccatcgcttcgctagaacggcatttcaaccagtggtacaactacccttacattttcctcaacgacgagcccttcaacgctacctttaaggccgcaatctccaagtccaccgctgctaagacggaatttggagttatccccgactctctgtgggacttcgacgacagcgtcgatcgaaaagagctcaagaaagcgttgcagaaccaggcggaccaaaatgtcatgtatggcgactcggaatcgtaccacaaaatgtgccgattctactcgggcaagttctacgaccacccgctactcaaggaccttgactggtactggcggctggagcccgacgtgcagttcttctgcgacctgacctacgaccccttccgatacatgcaggacaacaacaaggtgtacggctacaacattgccatcaaggaactcaaggagacggtgcctaacttgtggcgatacaccaagtcattcaagcagaaaaacaagatgcagtccaagggtatgtgggaaatgtttctgcagacagcggaggagcgagaacaacgaggaggccaccctctcaaggacgctcgaatgtccgacaagaacgacaaggtcaagggtaaggctgaaactaacaatcccacctccaagcggtttgctgatcctgattacgaggatatgggagaagaggcctacaacatgtgccacttctggtccaactttgagattggaaagctctccttcttcagatccaaagagtacagagactactttgactacctcgaggagaagaagggtttctggtccgaacgatggggagatgcacccgtacattccctagccgtgggtctgtttctggccccctccgaggtgcattatttccgagacatcggataccagcattcggacattttccactgtccttacaacgccaagggcgcccagttgcctcctcccgagcggtactgggagggcgtttccaagcgaaccggtctcaaactgactgacgagcagatcaaggaggacgagaagtggctggttcccgaccctgcggaggaaggcggcgtgggatgcagatgcatttgtcctctggataaggcagcgttcatcgagccgcgagacggaagttgcattgctcactgggttgagaccagagacaaggggttgtgaaggatgtaagataagtgtgcgaatgggacatggcatagaacgaggaggagagaggggttggagaaggtaaaagaacatagcaaacggacataattaatactaccctctttgtgagcttaatgtgggttatcacataaaatcctcaccaagtctagtgttctatgccctttaacagtgtacaacaataagttttaaagacggaatatatgaggggtgtctagtatgcaatgacccatgatagttcttcagaccctgtacagtaatcaatgaataagttatttacggaggtttttcaggagtaggagcggttagtagccggtagcgggcttggtgctgttgaatttcttgggcaggtacttgacctggtctgggcagttgttcttaggaatagtatcatcgacaggagtgtactcggcggaaggaatggcaccctggatatgaaagtagtaccagacctcgttgagggctccggacttgtcacaggcaatgtgtaccttggagttggagtggtggtacttgagcgcggcctcgatgtcctgcttggggtaggtcttgtcatcagaaggccagatgcccttggatccgaggaacccgaaagtgttgagctccttctggagagcgatggcagttcgggcgtagtctgcaacattctggtgcttgtcagtgccctccttgtaacagctggggttgagggtggacatgcaagttccgtgcttgttccactcgtgctcccagaaggactcattgtcgccgtcgtcagagacccaatgctcgttcatgtagtcgagcagagaaggctcgagcttcttgatgatgtcggtcacgttggacacctcctgctctttgtcgcagtattgctgataagtgccgtcacagttgtcgggccacagtccgtggagggtgaaggcatcctcggggccgaagccgggatcgtagtcccagaactgggctaggagaacgagtccaccaggctgctgaacgcaacagagagagtccttgtcggtgatctccttggaacaagacaggggaaggtcagcgttggcaggacagtccttgtggagaggagccgagagctcaggctgagtgaagagtcggtagacaatggggacaccacaggcgggctgctcctcagcaacaacaaaggaagcgagaaaggcaacaagaacagaagagaacttcatggtaacgagcgaatagagctggcaacaaagtgacagggcttggtataccttggcgagatgacccaagatcgactatcgcacgctacttatatttgcatcgttacatacggcgcactccttaacaaagactagagttggccgtctgtcaatcggtgtctatggctctgccaatcattgatgttatcaacaaaccgtgcctgtgtttagctgtctcaggaggttaactttgagaggatagtgccctccgataggggctcttgggactaattacagatctagagtaactagggtcaggtcaatcgaacgggaaaataaatctccaccgtttttgtatattacctgttccgttctcctctccattcaccctcatttttttcacctcccactcatcgacacggctccgtaaacaaaaataaactcacaggttgtacatgaacacggtcccaattagtgcactccaaaagagcttgttattccgcgccctggttgccttttcgtcaactcgcttcttttagccccattctttccccgacaaccacgtgtatataagtcacgtggcaagttagcggtgaagtagcgcttcagactcacacacaacccaacgtgtttgaaattggcaccaaagtagctcagtgctaacgtaaaacgtgactcgtctattgtcttggcaggagaaccgatgtccaagaaactgctttccgtggggtggaagaaatcgagcaatcatcgataaatggtagatgctttgagcccttcaaatattggcccatctagcccccaacattccaagatgaaactgtcatccagctgtcattgtcaggacagggatgtctcctcctacgagtagtcgcattatgccgtacactatcttcatctcacgcttgtcacatgccgaggacccctccacacgcgcactgcaaacggtctacactgcctcccaaagtaacaagccgtcttctattggttcctcaggtatttaacacgtggttcaagctaattgtactgtaccagactgtaccattcacccaggctctcgacatgttccgagaatgtcaaccttccgagcataacacctgcatagtaaagcgtgataacaaatcctggctcgcttttcctacacctcatctactacttgtagatctacatatcaccctgttcaacatcaattatttttcattcattaatatcaattataacatctagtctcttaccaaaaaaattcctccgctcttgaccattgtcgcgctgaccgtcgtttgaacgtcttgttgatatgtatgatgtcatcaagtcagttagtggtattgtctatatgcaaataaatactgttaagcaggaataatgtatgctatcatcacaatacttatcccggaggtatgtgtatgtatgtgtaaaaaattatgccttggactccttggagtgcttgactcgaatgtgtcgagacagagcatccattcggctaaaggtcttgctgtcgtctccacagtgctcgcacttgtacgtctttcgaacagcagcatgaatggtatcctggtgtcgaatcagatcatagggtcgagaaaacacctttccacaagggcttccagaagaatccatatgctcgcacagatgcactcgtccctcggactggccggtcaccggctttcgtcgtcgagttcgtgcgacaggctcaacagtagacactgagtccgtgtcgttgaagccaggcgaagatgtggtgctgctggaggagggctcaaacaagtagtcggagtccttgccgagagaggttgtgctggggttggattcgtacagagtgtcttccagcgacaacgacgaaaagtttggaatgttggggttgtgaggcgagacgtcagcaggaccagaagtgccagcgggactaacaggctcctcaacgaggggctcaggctgatagacaggctgctgctcgatatgcacgtgttggggctggtcgagctgctgaggctgtgtctgtgtctggtgctggaggtccatctgctcaagaggctgctgctgaagatgctgctgctgctgctcgagaacaggtggctgatgctggtagggagtatgctgggtgtggagagtgggagtatcgtactcgagaggaggagcctcgaactggtcgaggtcgatatccagatccatatcctcgttctccatgtactcatgcaaatcgtcaaattcgtcacacatctcatcgtcgtcgtcgtcctccacctcgggagcagcgtcgtaattgaggtcaatctcattggtgtagggaacaaactgctggggctgctcgttgttgatgaagaactccagaccctgatcctcgggctgaccggcgtagaagtttgcgttcaggtagtcccagggagtggagctgttgttcttcttgagaagcgaatctgcaggagcaagagtctgtgcaaagttgttgtcgttgagaggcagcatatcttggttgcatgggtaagggtattggggcttcatcaggtaggagtaatccatctgagggtccatggccatgttgttatccatgttcatgttgtaatgctgctgctgtgtgacgtccagggtgccggggttgtactcggtgaactggtcactctgctgagtctggaccggcgtgaggttgggaaagtactcgtcagatgctatcataggagactgtgggtttgtggaatggacagaagtcgagctggagttgttggttgagtagagactgagtccgttgttcttgggagtcaacttgggagaatggggtaggtcgaagtttctagaaccgtcagttgtgttcatgtgaggtgcagtgtttggactgctgtggtaggaactgcgattttcctgttcctgtctgtgcaacttactgttgtggtagttaccggttctgcttagtaatgaagggaaccgcaaattaatttctttgtatgtgctgcgatgtcgtctgtgactcgcggcgtttcgaagtgtaaattattcttgcttggtcgtttgtgtgtttgtggtcgaaaacctggtttttggggctcgttcggtggcaaatgtcttctatataaatgggtgcggcctaagtttaagttcggtttaatttgtaagtaagttcattgtggtggtgggagatggaaacagaaagtgggaggaggaagagtgccgaaggggttggaagcggatggaataaggatgcatggttgtccgagagacattcttttgcaaacgtgacggtttggaagcaacaaacagaccgtgtttatactccaatttgtcccatacccccactaccgggtcaactctggctgaatatctccggtgttttacactgccttgttgccgttgttgaatgcgtcatgcaagcatgagtggggttagcttagttggagcctatgtgcatcaaacacgatgaagaggataaacacaggttacaggaggttacaggaaacaaagccccgtactgatgagcagtcatggatatgacacagcctatctcaaccccatgtgtttcatttgaccctgtcttcaacacacaagccgtatgttgtttgttatgttctggtcggcaagcaatagcacgcctctctagcgtctgattatgttaccggctccattcacctcggatgaggaactaaagatacccgagccctttagctccagccagaagacgtccccagtccttccgccataaggctatttcacatggatatttgcgtttgttgggctccttcagatatagtgatgccaataacattgacacggcagtgggcatcgaagagacgagcacatatctcaagcacaatcttttagacaaggcgcaaggaagatgcacgccattggcatctgtgaattgtatcaggtcagagaagcagccgaagctaatctgcagctgaatggtacttgtttttccactcctgcctatcaaggggtaaaataccaccctacttgatgcctcttatcaagccaccatgttgcaataagataagaaagtgcttccaccgccttctgacacaagacacacctattgggacaaccccttctttttgccacccaaagtttatttcccctaaggtataacccaatgccgcttagagcaacacgagcaactctgtttgctattattagccctcagaatatttgccactgagattagccattatagccgacagtcgatgtgtaaacaataccccatgtgaaacaattcggctccgatatagccaaattttctgtttctttttccgaaataatctgccaaccaaaacaccggctggaattgctatccccgatccgtccctctcggatgtaacatgccgtctccgtgttccacgatccacacttacaaattggtcatgtggcctagaagctgcgcaattaaggttgggtgactcttcctgcggctgaaatcacgtgaccaccgaaaacgacatgtcacgtgcgtgtcctcaaatataaaggtcctataattgcgctcaaaaaaccagtatacactcggttctggaatcttcctactttttttcctcttacaatcgctcttctctctgactcagaaaatgactcgtcgtcagcttgtgcatattaaaattcctgcatacgaagtcccaaccgtttgaaccttaagtgaaatcatgcatgataatgaactacgccatgaagtttctcatttcgtgagagagatgctttgagagatatatattagaggttggggggtataggcggagtgtctgaggtgtattaggggtgcatggtgtgaaaaatggggttatgggaggtaattttagcatatttgaggcgataaagccttatttgtgacctacgagggtcattttccgtctcaaagccttctctttgtagaaccaagagaaatatactacagaattattttttttccatttttttccatcatcgccagctcattcccggaattatcacatgacccctctttttttcgggatcaaaagatgtccctgaaaacatcggatagcccggcagacatgatccgaacatgtttcagctccgtgggggtcatcagaacttggtggaagaaggagtggcgatgggagaagaaaatttttcacactgacagtggtcacgggttcctctttgctgttgaacttggagttggtatctcggtgattgattagtcagacttcaatatgggatggacagtaagtatagctctacaacaagtacatataatacaacagaacatgctagaaggatttgtatcatcgacagaaagacgccttgccgactggtcgactggggtatatctatgtgtaagtaacgtgcgcctagcaatatcaacaatatttatcagccccaaattattgatatcttgtgggaaccttgaagtaagatcaactaaatgtgtaagtatctacttaccgagggcaggtactcaaaaaaaagctattattcccgtcataattgtcactacagactcaaattttttttcaaacatttaatattacaatcctccctaataaacaataaaaaagttgttagacagcggcttaaccaccgaaaccgtaaagggttcggccctgtcgcttgagggcgtagacaacatcaagagaagtgacagtctttcgcttggcgtgctcagtgtaagtgacggcatctcgaatgacagactcgaggaaggacttcagaacgtttcgggtctcctcgtaaatctgggcggaaattcgcttgacaccacctcgtcgtgcaagacgtcggatagcgggcttagtgataccctggatgttatctcgcaaaatctttcggtgtcgcttagcgccaccctttccaagacctttgccaccttttcctcgaccagacattgtagtagttgttgtgtgtgtagtagaaacagaagactctgtgatgaggagtttacttagtggggatggcgacctttatatagctttgcagcttggggcaggtccggagggtgcttcatttctcgcgtgaaccttatccccagggtgtatcggccccaaaaacaagccattgtgcccttccttttcgtatggctatcctgcagtccccctctgctaacagcgacacatctctatgaagtcccaaaaaggaaggagattaaggttctctgttagcaattgagttccagcgcgatgtgtgggcctcacacccagtaacagctatagtgatggcggcagtgtggaatgtaaacacactttggttgtttgcgtgtgtgcgcgagtctgtctatgagctctctttagttggaaacgaaagagggctgagtaagaggtggaatctggaacaaaaaccgaattacgaaaaaaaccaactaatctcaagtaatttacttagctgatctcccttagacactccccttgcaccttactcagccccccaaaatatccaacttcacgttatatccccaccacgcgaccgcgtcgtctttgcacccttgttcgcgcttccaatcgcatccaattaatgcgtcgcgctctctgctgtgaaatctcccagggttggtcgcgctacacctctggtatgtgcatatattgatcgcgcgtggctggttggagaatggaacatctacttttcagtgaggtaaagctgattaataggatattcacgtgatttagaatatttctgtatttttgaaatatcaattttgaccacgtccgactccaaatagcaccatataaccaacccctggtttagacccacacacactacttaccacctgcagcacatcacgtagacatccccgcgatcaatcgcatcagaaaccctagccctatttcgggaggtcagctctcatgcagtcaccagctcccctaaccctatttctcgttctcctaacagcgctatcagagattcgctatcagaaactctaaatttattaccggattggggaccgattgggagttggagcgccctaaccctattgttagcactaccctagccctatttcaaactcccaacaggcaaaatgcaccacaattttgacacaaagtcccaatactggaaaatcttgacaaccaagggggccaaacatgcaccatgaattaggcgcaaacacgggtatttcgacacaacacagcagagcatactctaaattactcccggccaaacaacacagcacgctccgcagcaaatctatttaaacactcccacgcccccccagaaatccttcttcacacaacacaacaactcaaccactccaacaaacaaatacaatggcccgaacaaagtctacagttattgcccgaaaggtcaccggtggaaaggctccccgaaagcagattggatccaaggctgcccgaaagtccgctgctccttccaacacctccggtggtgttaagaagcctcaccgatacaagcccggtaccgtcgctctccgagagattcgacgataccagaagtccactgagctcctcatccgaaagctccccttccagcgacttgtccgagagattgcccaggacttcaagaccgatctccgattccagtcttccgccatcggtgctctccaggagtccgttgaggcctaccttgtctccctctttgaggacactaacctgtgtgctatccacgccaagcgagtcaccatccagaagaaggatatccaccttgctcgacgactccgaggcgagtaaatggtttagcttgcttacttgggttttatttaatgagggtatttaaagtgtaatattataaattactaagaaaaaacatcaactgtacttcgcttaatacttggttctccacattcttgaggcttttaactcggctaactcagcagtaactcagctcattgtgcggtatgccatgcaacctactgtacgtagagtgctacaccaccggcatactgatgtcatggggggatatgttccttctgtacctacttccatgctccaccaatgtctccgcgatggaggatttttctggtggcgtctatatctatggcgctgtcgtttgccaccgtgtccataaattgtaaatacccaccaacttcgtgtcgcctgttccaccaccttccataacctactttttggaggcgcagaacagctgatacctgatcctctgcggcagcatgttccaataaaatgacccgaaaaagaagaataacgtcacgcggcaatacaaatgtgtaaataccgctgtcttaagccctttcttataccttttagaggctttgtgtctccggccactgacttgtaacccccaatttactttcacttttgccatagcgtcctttgattagccaattggcatgataggtccaaaggttgaggttctgagcaacgtatacgaagggttgctctcaatttcgagtgacagagtttcagcagcatgctaaaaaaggtcaggtgactcacccgtgtgatggtacgtatgtgtgtccgcaatgtatcagatagtattactaatcagataaacgttgtgtaccctggagaggacatgacaacactggggacggataattgtcgtatgaagagtcagaatattgtctgaattcgtgtaatagttccgattcaacaaaatggtgggtctttttgggtgatcctacggtatcgtattggtgcttcttgtggtgtaatccaaaggggtaggtgaacatgtcagtgctgagatttacgggacggcctaaggagatagatatcattccatggctatacacaagatatactccagtggtttgtgtacatgttcttttagcactctaaaagatgcttctgaggggtatcggctgttcgtggctcctcactggacccatgcctcgcaatgatactaccatatccacagcaagatcgacgttcttcttggtgcttctgtatattaagttgcttcctgggttcccatttccaagcagtcacttcatcttcgtctatacattacttcagccctctccacggttctccttgggtcttttcccattcgtcagatagagggaagtaccatttccccctactaataaatgttcattcgagtttggacagaatcttttggacattggaaggtctctgaatgtaccaacatccgttctcttgaaacctatgaagattagtgagggaccaaaccaccgtcaatacatacatcagctccatatcgccgccagtgatagacgtcatagtccgtttcgttggcaagcagtatactgtagcggctcaacccacccatacatggtcatactgccgtagttcatgactatcgaggcccaaacagtccccggaggtcgtgctctcgagggcatacagaagaagtagatgggggcttgttactcagttttctcaccggtttcatcaggaatactacagggccgcgcacggcgagatcgcagttcttggggatgtgcgcggcctgcaaggcgttggcggtggcatactgctggaaagagccgtcgtgggtgtatccagacatgtagtcaggttaatcatccttcagccaaccgcagctcgttacactgaagcagcccctaagcaaaggctcgttttttgtctgaaccaaaactagactgattctggccactccaaatatcaacaagatactatcccgtagtccagtggtctccataaatgtggttctcgagcttttcccataatcttttctttttttcattacagtaagctccgcaactacttgtagtcaggaacgctactgtagatgtcatgcaggtaaaaataaactgcttgtttaacgcacgactctaaagatacgaagaggaagagagaaggcgcacaaaaagaggttcaggagagaagcagacatggcagccaccaaggggctgataaaaaaaggattacagcacccaggattctcgtatggtctcccactacaatactaactaggctctctggtgcttgactatggctgatcggacgggaagccgtattttcaccaggatatggccgtaaccaaggactccgcaacggagaattgaactccggtcccccgcgtgctgaacagacgttctgacaggcggaaattctagccactaaactattgcggattttccgttatttggaagaaaatgttgcctctacacagtggaaaacactgtttttaaggttcgccacaaccttattttaacaatatgttattgaatttgaaatgagtctcgtgattttattaagtggcagaaaaggagatgtagaatacaaaacatgagaatggcggtattgaagaccagagggccccgaagaatttacaggtcttaataaaacacccaggaccctaatccacgccaaaaaaaaacaacctcctccctgtcagctgttacccgaaatcccacgttttgctcttttgagaacagctgagtttctagcaagtccaccactctcgcgtgttccacattttctcataacggcaaagatttgcgcgtgtggtcatgtctactctccccgctatcgagttgctcttgatttcgagtctctatatcttatcttgaacttaagatatgataagagagatagaggcatgtagatagtatggcgagatgtgagtaccgatagtgctattagaggtccaagatacaaaaaaatccctttggatgttggcatttccatgggataaatgcgttcttccatcatagtgcagtccatatcgttttctagacgctgcctattctttcttccccacgtctgtctcttatctcaccagacagagtttgtggggctagtgccaggagctagtgtgtggataatgatagcagtataaaagtgtcggctgtggctgaccctggccgtggtattgacatctgtttgttatcgacagttcccattcaccaacaactcacatgatcatcttctggattgcattactctcaggatcactgctctttggtgtttaccacttgatggtgtctaaacgacgctacaactggtccaagaagtggcagcgtgccagctccattacagccatggacgagaagcctgcctttggagtcaccgccgatccgcaacgaaagtggggcacctggataccccatccctttgtcactcctgtgccagctccttaccccaactggagtgtcgctcataccaaacctcttccttaccgacccttcaaacacaattatttcgtaactatgggcattcgaagcatgagttgggacgactggatcgagctggacaacgaatggccagaattccacgctcgaaaaatgaatcgaatccaagagagagcagacaagctcaaccatacggaaccctgtgcagttcctgccgtcgaagagcttgtggatgaactctcccgctacctcacttgccgataccccagtcttttcaagttcacatctcctggaattatgtctaacctgtatactggagaagtctttgacctgagatctcggccgtggaaagaagatccaatgaccatgtgcggcaagtggttgcaggacgacctagctgttatgattgaaggcgaagacggtcagtactacctcaaggccgggtccatcatgctctctggcttctggagactcacagacaagctcaacatgagtctggccgagattcacacttcaggagacgtgcctcatttcaacgccaaactcaagactggcatggagcgtttcttccagaaactgggccccgaacgcgctgtcaacagaaacaactatttcattcagaccgacaacgatcttgcttggtctcatgccattgggcatgaggattcagacaccattggctggtacaccgccgaagacgctgttggagtcgaccaactcaagtttcgaagtgaaaggcagtctctcagacgtcttccaaagactggagcgatcattttcaccatcagaacgtactttctgcccatcacacagattgcccaggaaccctactgctcagctcgtcttttggatggtatcagacactgggataaggacgtcagttcttacaaaggcttgcaaaagtacggccctgttctggtgccctatttggaggccatggcaaaaaaggatgaagagaggggcaacggaagggattctgaaaaggagaattatccttggtagaagtggtgatagcggtaaaaagataatatattttaggtgacctagtggaaacaacaaatctcatacgtccgatagggcataggattggtagcttcttctttcgtactcgtttctctcattcgcctgtatctactcctcgtgtgttcaatgcatagtctattctactgtacttgctcttttacttctggtggtgagacagaggcttcaacttgatgctcttggggacaacaaacacagcagaggcctcgaccaaaggaggcttctggaactcggcagtttcgatggtgccggtcacaagagccttcttgtctgaagcctccttgactcttgtgcaaacagtcacaaattggtcagttcgaacgggggccttgtaagtgattttcaggttggcagtgactccggttctgctgggaaatgccaggaaagcagctcgggcaagtgcctcgtccagaatggtggcaataactcctccatgcacagtgtaggggtatcccgctacatggtgacccagatgcatgacagtgacagcctccatgtcggtgtcgttgatgaaaatgtagggaggaatggtaatatatcccacccggttcatggtctcagtggaccccgtcagcgagtgctcctgcatagtcttatccataccctcccagcctcggaccagccggaaccgcgagtccttcatcaaagcctttacaatgggcagcttttgcatctgctcttctgtgtctcgaactgccatcttcttgtacgactcgttgttgatgtctggcaggctgttgagcgcaatctccatcaccttggtgggcgatacagtcattccaaccacacctccagtcataaaagcagcagccaggtacttccaccacgaccgcttggggcccttggcacccttggcgcctccagagacattgtacgtggtgcttgaggtcgaagtgtttcgaaccggcattcgagtgactcgagtcagccgaggagccattttgagtgatgatctgaacatgttgagtgatttcgcgtgagattttgtgtcactgaacgactccttttgttctcaatcagatccaagcgacgggtactgaagatgccgaaatgtctgtgatgaagaccaggttgatagcagaccaaaactctaactgagcggggtgcatccgaaacttgcggctgctgatttgcaggtggtttaataaggttccatattggagatatggtgggggaagtacgcatagggagtggggtgaaagtcgtgagggcgttgggatgctgtggtcttagtgccttgatatatgagaaatattggtttgatcacctttaaaatggcgatgtctgactacttgatagtttttgtatatcttattaaacatgtctgccagttttgtgggtaagagcagtgaaatgcaataatcgggctgctaggtagtagtattgtcggtagcgaattgcaacatctttggtaggtttaggaatagattcattgtgtgtgtatcttcttttcaacctctataatcaagtctttgcaatctcgggcactcctgtggtagtggaggtactcaggagccgtttgtgtggctagattcttcagactgtgattctataccattcagccaatatggatattctttccaagaggtctattcttgagttctcatgatttccattttccccaggtggcttcactgtcactttcacttgtctttgtgcctgaattcttcgtttcattaacacaacaaaaaccatcaaatgaaacctccaaagatgtgattgatctttgtcttgtctctaaagcttgaacagaactgattattaacagcttaatgtctcaaagtccaactttacaacgtctgttccgctaactgttggctgtaaaagacgttcagacctgagcgataacacatgacgatagtttgagtgctcgacaatgattacaatcgtatttattagtatattaaaaacttctaacgtaccaaaaacatcacctggctcacttggaaaacctcagaattggcactatatggtatatagagaaccagctatgaatcatgattctgacctcaatgtccgaggatgagttcataaatcaagtccccatggccaattgattatagcaaatataatttttcgctgttttcatctcattttggcaagttgtgatctttttgtgagctccccacatcttccgcagaatccagacctccgtactatggttccaccaattactatgcataacttgacaatgtgttttgcggggaaacgatgagacaacgaaacgtcgagaaatattgctattaaggcaagaaaaaaaggattgagataatccatgggtttctataactctctggacccaaattatactcccaaatactcctacatctgtctgaaccagtccaccacacaattgtggctcgtcggcaaaaacgtcaatttctcaaagtaggattcgaactttatagctcagttttcatcacagagagaccgcagtaatagtagattaatcagtatggcaacaaattaaccaataatatgtcttaaaaacagttacgtacttgtacttttacaacatatctaggacttttctgaaaactggataaatgaaaggtttaaacttgttagggttttgtccatagaatcagttgaccgtgtgagaatagcgaaatgacctgtcattgaataaatattttcacagtacacattttgagcctctataaatacttcacttctgtccgcaattaacagcaccagaactcctctttccagagacccctcaaaactcgacttccagtaatccaaactctattgctataggggcgcttagatgaacgtcgctactaagctgagttttatagctagggagatggatgctaagaaatcgtaataaatcaccaatatatatgtaaaaatgtgtctagtagtcaataacgttttttcaatcatcctctatagtcgacattatgttcggccttaaatcggaacttgttaatttagccgatttcaaaaccttatttatgtaaaataatcctacagcgccttaaatagagtaaagaggtaatcgcggtgaatgtgatcttcacgtgtaaataaaaaaatttaaaggcacaaaaatgttttcagtcttataaaaaacaaatatattagatcattatcgtcggaaaactcttgcaacatcccaaaacctcgttccgccatctcaacagctcggaaccttcatttccgaacactgcagcttaacccaaccactcataacctttgaacatcgaccatcacgacattctagacactgctaactacaccatgtcgcgtttgctgaactctctgcgggcgtacgcgcgcacttcgcaacacgtgaccaacaactccgtgtggtccgagctcccgctttcccgccgggcgtcagtgctggtcttgctgtttgagagcgagaatgggctgtccgtgttgctgacacaaagagcacacaacatgcggagttactcgggccacgtagcgttccccggcggcaaggccgactttgacaccgagtctgcgcttcaagttgcgcgacgagagtcctgggaggaggtgggacttgtatccattgatccgacagactctcagcaacgggtcattggagacctgacaatcaacacacacacatccgacgaagtcgacacacacgactgtctgacgccaccactcaataagaacttggctgttgaaatcgaaccgctatgcgagctaccctcatatctcagttacaacctgctggctgtcaagccttgtgtggcctatggaagggtcgtggagctcaacaaactgtccgaaccaggcaactttgaggaatacaaataccacgactcgcccaactcgctcaaatcagccccctcggtgctggatacgttgcacccgtgggtggaggaccatgccgaggtgtacgagtactttgaggcgccgttcgaccggttcaccaagaagggcgacggttggtaccgactgcaaaagtggaactggggaggaatccactggccacaactgcactttaatgtgctgcgcaaaactcacaagaccattggagaacgcggatggtacgacgtgtgggggttgactgcccggatcctcgtggacgcagccaccatcgccacaggaaagccgccggaggtggattgcatgaaggttgtgggcgatgaggatctgatcagaggcctggcggagaatggccggatgcctgaacagagagtacacggagaaaccatcaccgactttgtcagtattcttggcaaggatagccctctgattgctgcaaggaatggcatcattaagggcactactgctgccgcggctgcctaaccagaccactcctactgacccctttgacataacagacataaacagacataaatggcatatagataatacaatgcaggggcaaatggaccggaccgaactggatccattgcttttgttatagacatggactactaagtgagtgagtttattactatctctctaggccaaacagatatagtcagcagtaagatgactacaagacatttgtacagtaattcacaaaaacttcgtatgaactttgcagaaacttgaatggcggtatatcgactatggtgattcaatcgaggagtgattcgaccacaatagttactagagctggtcctggctctgtatatgctatgtggcttttagacgttcttgccacggatcaccagaacgctacaatatggtgtgattggaataagacaaaacaacacatcaatcaggaagatagctatcaatacaccacattgatttctctccaaaggggaaaagatccgttcaatttttcattcaagaaagcaagtgttcccctcagctcaacccaaagtcgcaaaaacggctgatcttcttcaatattagtatcaagtgaaagctactgggtagttaagtcagatggagctctctttttttccgcatagcctgagaaatgatgacataatccgagcaattgtatcattgcaataatagatggtgtcagaaaatgccagaaaactctagaagaacacatatccacgcaatacgtcacctaagaaagtctccttctattccagtattattaccagtttgaaatcacctttcgcaccgtctacaccatataagcttcgatgttggattagtggcgagcttatctgcttggcgcaaataatcatgttgaataccccacacaaataagctttctggtgcattttacttaaccgaggtagcggttccctcatcaccaaacagcagtcatgtctaccgacgagatcctgagaaatttcaagcggtttgaaaagcagcgccttaaggacgcgacgaaggctggtccacgtgattttcccggccagaaacgccccaaaatcggcactacaccatggtacaccattcccctatcacgtcgaagcgctgttctgatgctgctgtttgaagtggctaatcccgacaagccagctggaaaggagctacatattctgttcacagtcagatccgcgcacctccggtcgtttcccggccaagtggcgcttccaggaggcaaactagacctggagctggatggatccaacgtcagccatattgaagcagacctgtgggagaacgttgatcccgcactgtcaagtgacactgaaaagagattgtctgagtcggcatcgttttctgcctggagtattgctctgagagaagcctatgaggaggtgggtctgtttggagagttcatcaatgaagacacgaagagcattttgatgaacccggtggatggaggaagggatgccaccgggacggaaaagccaccttttttgaacgaaaaccctctcttgtccgtcgaaaaactgtgcgagttgccaccctttgtctccagaaacggactgggtgttgtcccatgtattgcatttgcacggtccaagcaacgcggacaatttctgaaatactcggagatttgtcccaagcttaatttcgatgaggttcaatctgtcttctccattccgttggattacttcttatctaaacacacctcgggtggcgttgagttatacaactcctacccccgagcagcgtggggaaacaccggggttgattggattatgcactcattcaaccacaatgcactcccatatcccaatattcggaatggcgacagtaagggccgagtaaccattgatgatcttctggctgaagcctcggctccgcaagttcagcctggagaactgacgcaggtgggccagaagatacggtcacgtgagagtattttcagcgagagtggccccgagcccgacccagcttcgttccacaaaaacgtcgtggcaagcgtagacttgctgcctcctatttggggtctgacgggtcacatttgcatagactgtgctcgggtgggtctgaatagagatcccaccgagtttgattttgtcgctgacattggccaggactcgctggtgggtcagttgataaaggagggaatgtttaatccccgccctaagaagccccagtcaagggtttagaacgaagacaccgacgtcacggacattaattacttagagggatataacggaatccattaaacatggtctagaattcgaatggaagggattggcggcgctagttcaaactcgcgaggcatgtctcgtatcatggaaagaaatagaagggatcgattgcagttacgatctgacccagttgagtcaattgatgtaaaagcagtacaagactcattccacgctgcagaagtactggcagtgggtggctgctgtttcatcaaggcggttgcaacagcttgacacgtgaatttcacaagtaaacacagcaacaatctataaccaagtgctcaaccagtcggatgcataacaccagtgctatagagcaatcctgactgattaccccatcgcacgtcaactatggagcttggttgcaagcaatcaaacctacttgtagagtaaatctgtctggcgagacacgcactgtcttccgttagcgagcctccccccactacttgtagagacagtaccgtacttcaacggcgcatgggcgagaggttactttctgcggctaaaaataacatcgccgtctgcttcccatatcatcgccatgtgtcaattcagcacgagcctgtacgggatagaagttcatttcaggcgtgttcccgctgacatgttgcaccttgacgtaagtgttcgttgcttaagtgctcatcggataaagtgctcaccagataaagtgctcaccgtatatctggtgctcaaagatgaccgcccattccggcccctctgtggcttgaaatcaagcaccaactatactctccgtcctcacattgcagacccgaacacatagtgagcatgattcttgtcttttctcacccacggcctaaccttcggaccaactacagcacggtaactctgtagactaaccttggctccaggttgttgaaagagtgtccaatgacgaggttctgctccaagtgcagtacaactggattgtcgtcgatgcatggttgccaaaatgatgaggtcgctggcatgcacacctgtctgaagctgagagggatgaaacctcgttgcttttggcaatgtaggggtattgttttatgctgcgaggcggtattcaacctaaggtaaaaaggcactttcagtgttacaagatcttcttgattgcaaatgctccattatcgtgatggcaccaccaacgataatctctaggccagagtgcttgtttcctccaccctccaaagacagggtcttcccccgcgggtataggagcgaagctcagctgcaggttatacgcagtctctcggcctaactcgtgttttttagcgtggctgtgattgctatggtgcatatgaagaaaagagtacctgtggtagttgccaggcaaacattttgttttaatgggatctgagattatggccgatgccagggcgatgagcacggcgctaattgagaccgcatcggatgctgacgtatctgtatccaccgccttccaagagtcaatgtcgctcgatatacgctcttggcgctgagatttttgccgaaagggccatattcgctttgcgcagatacctccagcagcaaaaaccgttggaggttagttgacggggccgatcagcgctcctttgggagagcggacacccacatgtcctttgtcagcaggtgcttttgcagaacaatagtcccacgaatgattttcggttaataccacacagagcaggcagaccccacaagaccgtagcaatcgagatttaagtaacaaggacgagatcttcatcatctgacgggaggagcttccgccatatttctgctccgattcgctctgactttttttcccggatatctgtctcgaagaggatcggtccttcttgttcccaaatctacttcattgtgagacagtcaagcgacgatgacacttggtatacatacagcatgatacttggaggccggatccagctacgctttagccatgtacatattgtacatggccgtggaggatacaatgaagacatctacggctgcaggagagctccgctgcaataggcaaggcgacagcaaccttgagacacccatgtattatcctatgtatgtacaagtatatacttgtacatgtgttacggaggccgatatgttttttttttttttcttttttttttctttcacatccaggctggtccttgtctgcactgagagacaggatcgtccaactcaacccatgtttggctgtgcgtttgaatttgttcttggagaggacatggacattgtggcaaaaagcaacgtcttgcgaagcagcgcattttgttcctggccaagtactgtaggtacagttacatccgtacagtggcattcgtgctctctcgtgcctggtccggaatctccgtttcatgtaacaacaaaggctgcagggtacagtaggagcttgatgcgcactacgacgtacgacgctacgaggcaccataggaactctcaagcaaactccaagagtcttctacagccataagcctccagttatggatggtaccaactttggcgaccctacaatggttaaatgaaaaccttgggtgcaatgaagatcacaggcagcctggtgacaataaaaaaatgcaggggtggccacgctagtgccttgcacatgatgaagggtggtgtcagaaagtgcaacgtttgcagtcacgtgaagtgctaacgacaaatgccacccaccgtggaatccaatcttgacttttgtccctccaagatgcgccttccagccgctaatgttgcatcttgtccagggcctcatctccgctcgtatatgctgtaatagtagagcgtgtgacgattacatatagtatcgtcatatcgtgtctatcagatgattatcttctgtatcctcgctccctgaaacactcaaacactgtgttctctccatgccagtaagagatctacagtcggtcgaattcagagtcagatagagtgccgtgagtgcgtctcttgtagaggttcgagtacagcaagggcccgactctctggggatgtaaagcaaacccattgaggcaatctgataccactccactccatgtaacctggatctagactgtgatccaccctccttgtctactgaaccataccctggttgtcacacccgaaggcctgttacatggccccacttttttccacttgcaacctccagtggcaagacaagcgagaccaaagactattggccgtggagatgcgcccgaacgcgtaaccgtggcaacgcgtggctgacttctcaccgtgcaagaaggtttggttgtcaggtggaagggagatggaagaaaaaggaagtgtgtgagctacgaagtacgactgccggagtacttggtagtaaaacggagggttccaaaatacggcgcggacggtcctttgtttctaggtgggcaacggaggctcatactaagcgccaaaaccgacatgactatacgctgcttgctcgtacgaccttgtcagtctcctgtctgtcactctcactgtatatctttaccctggcgaatacgtcacctctttgtgcgacggaaaaaatcacgtattggcatttaaggcttttaagacgttggttagttgagactgtttcacctgttcgggttgagaaattcagccgaatgaagccgataactgcggaaagccctccgtgtacgtagtgtaggtgattagtattacaaaccaccgagtggcctcaatagccgaattcgtttctaccgcgtgttcgtgggctagtggcatatttagccgtcgtctcctccacctcaaatccacgtgcctcctctgcgtacaagtagttggagatagcgctaagggactcaaaggtgtaggttagacactcaaacctgttcaagcggcgcggcagtaattatctcctagttgagccatggtattataggccactcgtatctgacagtagcgacggatctagcactgtcgagcaatgcagcttcaacctggggtctagtgcaagtcaacaccagcggcgttcgacctcgtatctaaacccctactattgcttgtcagtggtttttcgcttgcatcatattgaacgctgttgaagctgcctgccgacaggatacaaagggagtcgttagtggtagctaatactctgatagagggctcctggaagctacaagtaggttacaacaatggcttgtgccgttagcgccggtgtataaaaacgggatgaggggagctggagccgcagtctccgttagcatctgcagggacaccggcagagcccccccctagctggcattccggttccgtctcctacacttgccctcaacttaaggacgtagatttgtcttaaaggtggcctcagccgtcacgacgacggaacaggtgtagagtttgcaaacactaaaggttgagggcccaccaccgtgaaagatgaaactatgtggtggaacaatgaaagacgtacttagggtgttgaaggttcgtcgtttgtgagcagacgagcttgtgggccagacctttgacgtttggacagaccagcccatccagacccatgtacccactgggcagcgctgtgctaccccagacaaagtagcaatctacagagcgagcttctgcaaagagacgcacgaggcgcaacagacaatacacatctcgctaagaacagagccatattatggtggtgatgcgtgtctcatgcaatctgaccctattgaaaaaagtaacgaaaagtgagctttgtagggagaggagggcaaaagatgaaaaagagcaaaatggagcgtggtttgcacaaacgagatagaaatctaagagataggcaattgaccctttaaatccgcggcagcttcttatactcgcccagctgccccatctttccacccaagtcccgcaacacttacaacctctgtcaaaaggcaatctgctgtctcttccttcctggtccgagacattcgacatcgacatcgagacctacaaccaaaccatcaagcctatcgagccttggaatcgaagacagtcttaatcgtgcttctcctccgtgatttttgttcctcttgttccttttaatccattcctgttctttttttggcaccatactacagcactacttgtacttcactttcgtcacctccatcttctttttttgttagtgtattgtcttctccatccacggaccacatcctttggcgccattcgacaaatccaacaaccggtgagtacgcaacgcgcatctgttcacacagcccgcccgacaaagacgaccgtcgctcctgcaaaattgattacctaattcaatcgccaagacccacacatacatgttcatgcataatcataaaagcgcgccctcggcctcacgcgccatgaccgcttggaaaaggtccattgacaacactgactgaggggtattcttgcacatctgcccccccagctagggccactcggatgatgggaacccggtccagcctttttccgccgactcttttttccatgcatcaagatcttttggacgaatcagacgactttttccccgtgtgtcctacccaaccagtttaagctcgcatccacactctcagctgttcgctgccagcatccttcttcagcttatatgagctgttgtcattcactaaagtgcgagaaagctggcgtgatttctaatgattcccaccaatctaccgagatatgtgatttgcctcttcggttttcccttgcgtacacactgtatggtgtttccttgtatttcgtggtgtttgaagctaacccagacctgtggaacccccccacctcctattacatcaccacacaccgaacgcagcccagcgcactgagctgcatcggtcccctccaaataccaacaagccttttgaatttgagcaaatcgcagcacatttttttccctcttgtcactttttcgccacagacaggaccctcaacgactattatcgacaccaacaacccccatacctttgaaatcgtgagtatccacgctgaagagcctgagtccggagttggaagtgcccccaagcccgcaacagcgtgtaattggatgtttttggcgaatagctggagtgtcgcgcttagtcatcttgatagccagtccaagaacatctcggaacctcccattaaagtttctgtccgacagatcagattttagatgcaatatcggttgtccaggaaacagacagatgggaggttaaagagagagacagtgacagagagacgggacggaggttagttaacgagcaaaaaagaaaagacaagaccgagcgccagaattccccacaccgctgacgtgtcaatgtatgccggcaggtgacaccggcaggtgagtggcccaagagagtccgtgtgtgagcaaattttcgtgtgtcaaaataggagcatcagccaccaccttgtgactgtctcacttattttttgaccaggtcttcttcgcccaccaacaactcagccttgtgcgcacttgagatactcctcgcctcattcggcttggcgtgggaggagtgtctcgagtctactctacactgaacttacgctggtagtcaatcttgtcgccttttggttttttcgtttctcccacttttctatttttcattttcccgatcagtgagcctatcttggtttgactttccaccttatgccagttcttttgtctcctctagctcgtatcgcgcgcatggaagatagtcctggacatgtctgactccaagctcctggcttctcttctttttaaacccagccagccgccgcccaccaaggcctctccatccacaattactttgcatgcatcatcccacgacaccctccaactaacacagatgtactcatatcccaccattgaagagccgcagctcgcggatcaggactggtaccctaccacacaggactttttctcctaccccgttcccaccgtcgcggaccacgagccctccccccaggcaccgcagccgcaaccacagctcttccgaccccagtacatgggtcgtagtagctcattcagcccctcgctggaccaattgaagcgaggtgacgacttcaaaactctcatgttgccgtcgtcctccaacatccatgccaatgctccccacacccaattcaccgccacccgcatgaagcgatcttatacacagcccgagaaggacaatgatactctcagacggtcccagtccatgatggccctgtctgtttccaccgacggacgagcccgtctccagcccagagaatcgcgggctgcgcgagatcactcgccccacaagttccgaatcgaagaagacattgattcgcagtcgtcttactctgataatgtattttcggaccggtcgtctatgtcgtcggcttcctcagcatctcctcagctggccacagacttcccgtcctgtgtcccagtgccagttggagtgtctcgatccaagtcctgcgtgtcgctttcgcagtttggaggctcggcatacccttctcttcctcctcctgcagtttctgctgcctcatccacttttcactctccttgctcctccccttcccccagcgtttcttcttcttccgacgaagacgacgaggtggccgcccccaaaaacgacgcatgcgtggcgctggctcgtctggtggcccgaaaacggtccaagtctctcaagagtaccaacgctgctccccagagacctccacatgtccgatctcggtctctcgtcggagcctcggacacataccaaactcgagctgctatgtcttcgacctctaccatggagtcgttccagtcgcgagcaagacgagcctgtgcaccggtagtgccgcccgctagcatgctgactccccctgcctccgccacctcggacaagggctttgacttcggcatgacccgaacttctatgagatccatttcccccaaacgaggccgaacctccatggccgtcgcatttaactacacagacggttctcctcattcacactttcatcgacgacaaatgtcgctcagtgaccttagccagctgtcgctccagcccgtacagtctgagtggtccaactaacttgcatagatgtatatatacattgacaatccaaaacaaagaataaacgaataactagtagagagatccgcattaggtatggtctcgcgctcaataagagacccggacatggtgtttcgatataaatatatgggcctctatggtcaaatcacgatcaagggaggagatctgtcaattaggtgtatgtcaaaacagcctaacatctgtccaaacaattccaaacagttctaaactcctgcaagcgccattgacggcgactgtaggagtaggcacataatcgggctgataacagaggctgcagataataaccaacctcgtacaaaagttttaggcgtattccctatactggtacactcgctatggaactcctgtcatcacaaaacttccagataatatccggcagccaccgactagctctcgcaccacccttgtcccgaaatgggcaactggcacgaggggaacctgtattagtggagtagctcgttctaactgattttggtgttctgccgtttgcacactcgccatgttctccatctgcaggtgatacttaccccttggcaacaacacatcccgctgtttttagtgccagactacaatgggagacttgtcgagtccgtggaggctccgaaactccccatgttggcatacagggcatctcttactatcgcgccaactagcgccaattctaaccaccttatacctctagacgatacacttgagagtgtaagacgctagaaaacggttaagaggccacatcctaggggccaaagtcaaagccacaggtcacacagtacacgtacgcatcccattgtgtcagtgtctccacacttcgtttttgttcgctcttgttgcagctcacgtatgtacgtcgttatgtctcaggtgccggtattccgagcccgcttttgcccttaacaagctgacgtcaaaccacagcggttgctgaaggtccgctaacaattgcctaggttaaccgatagctcaactctgtcgcccaccttccaacaagaccggactgatagtcgtggtagcataaagatatagattcttataccaatacagggaacaataggagacaattgattgtttgggtgtcataagatgcagttttccgagttgatagggactggcttcccacacgtgggccgtaatcatagcgcactttgtacatgtcttcatgtacacacggcgttatatttccaaggccaatagtctacgatgcagtaaggacttcacaataaagggctgttggaaaaagacaaggccaccgctgagagccaaagcaagaaccaaagcaaagaaccaaacccaagcgtacagacacaaaacccacacccaccaatagatcactagacaccctcgtcttttgcccctccatgcacactcaaaagtgacacacaaaaaaaagcctacttgtgctcgtacttttgtactggaggaaatgtctcaacctacttgtcgacatgcatagacgagagtcaaacctatacagtagcgctccaaggttggcttcaatgtatccctcccttcaaagtgtagagtatagatgcgttgaaatgaggtgtattgagagcacaaaagcgtaaatggccggggtcgtacgatcgacaggcatcgctgactaccatgctcttggcttttatatcgtggcttcagctaacaagacgctagcggtaacctccagtgttgaagtcagcgtgtccaagacctgctctcgagacaagtgtcttgttttagaccgaaatgcacacatgctaacgcattctacttgtagggcagcccaatacccgacaaggagccggcgactcctggctagggttggctgtgtcggtacaacctgcgcaattgcctgacacactccaaaaaacacacgtcagggaacattttgaggttgcatgacatgatacaaaactctgagatattcctctacccctcccacaaccaaatctgcacctcctatctgtgccaaaaatatcttatgctctcagtgccgttgagccccgttgccattgtgggacaatccccttttgcccccacgctaacccacttaagcacccccctccgtcggaagttaactcctacagctggtcggaagggctagaacaccccggatagtgcgtatagaggccacgccgatgatagtgagtgtggactgggtttatatcggataaaatgtagataccatatatacgggctctcacctgcagcatgccaaccacaataacctctatggtatcgtatagctgagtagctgaggcctcctataccgcgaacccttataattgactatagggagtctccacaaatgcccaaaacaagctacaagtagctcgtcttgagtccttgttggaagagtcgggggccaattccgtatgcgttagttatttgtgttactcctcgtctaaacacccttgtcgaaacaagagacaactaactgacacttatctcctgatctacagcgacagtacagtatgtacagtagctacaaataaatgagtaggctagcccatggaagagtatgtggatacattagatcgcagtagcggttttctacaagtacagcttagaaacacgtgctgctccagatcggttattgatttgtaccctgtaaagacctctaaactcaacccgttgtctagctaacataggggctaagtgatatcattcatctatctatttctaatacttcaacgtatcacatcaggcatacggtacaattccgctttcggtctcatatttcttggctacgctcaccaggtcatgcaaatggtggtcatgtgcctcgggggccagctcgatcagagattcgtatagacggtacagatactctcggttctcgccgctgggacccttgctgtgtacaatgtgctttgccagttgggtggggtcttgaggtcccacaaatgcctcgttgtcgggagtcccgatgaagcacacggtttcaatctgggtaggcacctggccgtcgaagcaggagcacgggtatgcgtccttgtttgcccggaggctctcctgcgacacgtggaacggcacgttatgcacactgtaaccattctgctcccgtatgtccaggtacgtcttgacttcctccacgtattccttcttgattcggtatgcgacaccccatgtcgtacagtcgtcgtggctggggtggggatcatccaggctttcccagaaggacttttcaatcagggtcaccactctaccaggagcctcgggcacacctcgatgatcgttggaagactgccagaaacgacgcacatagccggtgacatagcccggaagacggacatcccagtggggtgggggcttaaagatgagtgaaccgtagccaaagatccagtactctgtgttctcctctttttccggtgcgttctgtgcttccttcacatcgggaaagtcgccgttaggagcagcacgcaaaggtccgttttcgttgatcatagttctcggtctgtatgctctatggatgcagttctagtggcgtgcagcgtgtgtagcgagctttggcgtagtgtggcgctcacactatttgtatacagatcacgacagagttgttaggtggaggcaaatagacctttggattatgcgtgattagctttttgttcacgtgacttgaaagggtcggtgcaaagacgacaaagtacaccccctgtacaatcaacacgcactataacatctattgtttatgtatttaggcaacagggaaagtacgcgctagttcgtatccgtcggcaatgttctggactcgagcatctagcttgaaaccctgagcagcgagctcccgcatagtctcggggaaggtcttgagaggcacggagaaggtctcaatgaactcgttgtcctcgagctggggctgtgggttcttgttcttctcgtcgttgagatccacggaaacgtgcacaagcttcatgttggtgttgcagaagcctggatcgttgaacatgacgggggtgacgctgaaggcctttcccacatatccagtttcctccaggagctctcgctcggcgcaggtctcgacggtttcgttggggtcaagcaggccggcggggatctcaatacagataccatccacgggagggcggaactgtttttgaagaagcacctcgggtccagtctccttcttgagaatggcaaggatgcctactccgtcaatatcctggccgggcactcgggttcgtcgagcggcacattcccagtcacgttcttggttagttgaatggagcagataggtgtcgttggtacaacagatcgttgcgcgtgtgttatcgtcgtcgtcttgtgatcttgcattctcgcaatgctacccgcatctcactcacgctttccttcgggatcctcgtagaagatcttctgagtcttaacccatttgcacttcgaagagtcgagatcttcaaacttgaggactttggcacgggcgagattcatgattgttcgacgcatgggtgttgggacgcgagctggttataggtgtaggttcgttgatgacgtaatgatggaaagcgagtgaaggttggggcgaggagaggctacgggttgtctcgttgattgattgatggtgttgctgttttttcatcgacaaaaaatacgtcttctttgggattttaatgacaacagcaacatcgctggaaaaatgatatatttcataactaatagtgcatcctactcttgatccaacagttggcattgtagtttagaagtaggtacttctttatttcactttacaaaggtcgagaacgatcaaatactacccattgtatcccgttgagtcggcgggaatgtttttatatcttttcgcaacgatctcagcaagcatgtactccatctttgtctcacgactcgtacaattctctgttctggctcacatatgcacgcatatttatactctcttcggccgacttaaccaatacactgcacaccaacatgaccgaccaggtacgttcggatgtccaggaaaaactggttcagagcggagagtacgaaaagtgagtacccaaatcatggacacagacccagacgcatggaaaataatcgacattaaacacaaacaccaactaaaccagactctctcaacacatccaggcccgacttcgaaacagcggctggtacgacaaggtcagtgctttggcccaggaggaggctagcaaacaggataaggtggaactgagttctctgttggaaaaagtacagcctcaggcatgcgatctggttgacgacgacatcaaggtcgagactctcaagatgattgcctcttttctcgagggagctttaaagtagtggaggactgctgtatttatgtgcactaatgtatttatttgaagaatgaggagcggaagtcgagagagacttctaggaacggttttaagtggttacggtacttgtatttggtactgttgcagtgagccaggtataaccttagcgtagtgggcgggctactggttgttagtatgaataattcaaccagatcatcgtacgaattcttgtctcattcgtaagatatacgtgggaaacagagcactcgtgccatatatatgtcacgtgacgttcaacttcgatcgatcacgtgccacgcgtaccacccactatcgtaatggcactccgttacaccattgtattcctcctgttatcaggcttgcatcatcatcacacccaaatctaaactctcacaccacaaccacatcaagcaaaaaacaccatggtacgatcagactggagggcgcaggaaatcagaagagtcatgacgttcacggggagcaaggagaagacagcccgtgatgccctggaaaagtttgactggaacgtcgaggtggctatcgatcatattctcaacaccccccaggtagacctttcaggagctagcaaggtgtttgacaagtaccgaaatgccgattcggacgagatcgatctggatggaaccattcaatacatcactgatttgggtctgtcgctggaggagcccactgttctggcggttgctatgactgctggatctccatcggtaggcaccttcacacgaaaaccctttgttgagggctgggctgccattggcggcgacacgctgccggcccagcagaagttgtgcaggtcgtttgccgagtccatgacctcgctgaatgccgatttccagaaaatctacaagttcacatacggtttcctgctgcaggagggccagcgggtgttgcctcaggaaacggctgtggactactggcggctgctactgacggggaaatacgagcatctggacaaatggctgtcttttgtgaccgaaaaatacaagcgcaacatctccagggatgcctggaacatgttatacgagtttatgctgttccaggccaaggatccctctctagagagctacgatgaggacggtgcctggcccagtgtcattgatgagtacgttgagtttctcaaggagtgatgtatagttggagacggtatatgatagtaataaaaattcaaaaataccacctttattttttcccagttcgtttcctgtgtcgttcttaccacctccctctataccctgtacctgcttattaagtgactaaattatagttcgtgatgatacacgttgacgtgtatgaacagtgagatatcgccaaccacaactctctctccaaccacaacatctcaccacaaaaatcaaaatggaggctctgcgatctactctggaggccacaattgtaagttaccgaacatccctgcactggcgcactgctactacgactttcccccactaacacaggactttgagggccagaaactgtccaacttggccaagacccgattgctggttctgggcgccattctgtcaactattactggctttgcgctgggtgacgtgatgatcatctggttcatgtttgcctttgtggccggcatcaccatgctgctggtggtccctccctggcccttcttcacccaacaccccgtccagtggcagacccctgcctactagtttgatacgtgcggcagcgctttatttattgaatgggagtaatagaggtggagtgaatgttgaaaagaggaatggtgttgatcgttgaatgtgagccatgtaggacattgggttaacgagaaagtacttgtacatcgtgctggagaatgaatatgttggctagagtgttagtagaatctccttggagagctccattgtctttttctctagatcaatgtgatcaccacgacgccatgaatgtcttcataatgtcgctctggtcatactgtatgtactattcgtagctaggagatgtagtggctactctgtagggtaaatagtagtaagtaagacaacatgaatagatctgtcacagcagctgtcatctattcatgctggcattttcaatattcgacttctctgcttctttctttctcagctgtacaagctatcttgtagcgttttctcataaccatcagctcaacaaaatcaatgatcttatacctaactcttacttgaacaaagccacaacccagatctaccactcgtgaccgcttgaactggtgatctgactaacaactatatccccaaccacatatatcctgtctctctctctctctctcgctttaattatcatataaattcttcattccccttcccataaacacttctaacacaagtattgactagtctaccccaactaacctcaaattacgtcatagtcagcaagggcaatgtgactcaggactacattgtggggtcggttgatcacgtgactaatgagaagtgtggcgataaaggagtcgaatgctaccgaaacgagaccatccaatcacgtgacccaatatcatctctagtccccggaatttcgcccacctcggccattggtcgggattcattatcgtgacttagatggtctgggttagggttatgtgatccaacttcccaacggccagtgtgaaatgaatgtgccgtatatgacttgtaagtcggtcaatagtggcgaaagactgctgattttttcagttattgcagttaaaacgctgatgaacagtatgtacaaatttcatacctccacactaacgccaccacctacaaactgccaccaaagttctagaagaatccatgattgataacaaggtttctgtatgcagtgttggaaaggtggttatcactgaagtcgccacctttgcatcccatcctctgtacattgacaggaaaaccgctttgaccatgattagatcaacgcgagcggcctctcggcttcggctaggagctcgttactatgcgtcacacgccccctatggcgtgctttccgaacatttgaagcgcacccctcgaaccaactctcaacactactatcctcctcctcaaggagcccacgaccttcccaaggtgtccagcatgggagattccatcgcgagcattgttcgaggacgagagttgtgggtccaggaaaaggacaagtccgacaagccagagaaatctgacaagcccgacaagactgataagaccgacaaggacaagcctgagaaacaggacaaagacaagaccgacaagcccgagaagaccaaggtgagccacaccccgtcatccactgcatccaccggagccggagaagctgctgctcctccttctgcgcctccctcgggctcgggatcatcgtcttcttctggaggagggtctccacctgccaagaagaagaagagccctgcccagacctatcccgagattttggcggtgcccatcagcgaccggcctctgcttcctggatttcatcgagccctggtcatccgagacccgaacgtgatgaaggctattgacgagatgatcacccgaggcgagccatacctggcatgcttcttcctcaaagagttttccaacgcagacgtgatccaggacgcctccgaggtacacgacattggagttattgctgagatccagatccagtcgcaggaccacaagcgatccaccgtcgacgcctccaacgagcctgtctatgtgctcatactctacccccacaagcgagtacgactcaactcgcttaaaaaccctccttccagcggcggagctgtgtcctatgcctctgtgtccgaagacgtggctgaggacggagagctgctgctgactagcaaggatctggaggggtactcggaggagtttctggaggcccgagaggaagccaagaaagctaagagtggcaagactgaggattccaagcacgattccaaggttacttccaaggacggcaaggagaccaccgaaaagtacgactcttcaactcttcaggagtccccttactcttttctgtccacctacgatgtgtctacagctgccatttctctaattgaggacaagccccacgacaagaacaacagggtcatcactacattgacaaatgagattctcaacgtgttcaagatgctgcgggctgaagacgccactcttcgagaacagctgtcgagtgtcgtgggcgatattctgcgaaccgagcctgcagttcttcaggagcccggtcggctggctgactttgccgcggctctgtgtgctggcgaaggaaaggagatccaggctgttctgaccgctctggatctcgagactcgtctcaaccgggctctgattttgctcaagcgagagcataccaatgccaagctgcagcagaagattgcacgggatgtggagaacaagctcaacagcaagcacaaaaagttcctgctgaccgagcagatgaaggccattaagaaggaactcggggttgacgacggcaaggagaagctggtggagaagttcaacgagcgggccgagaagctggacatgcccgaaaacatccagaaggtgtttgaggaggaaatgacccggctgcaatccatggagccctcgtccagtgagtactcggtgacccgaaactacctggactggatcacccagatcccctggaacaagacgaccgaggaccggttcaacctgccccaggccaaggatgtgctggattccgagcattatggcatgaaggaagtcaaggatcgcattttggagtttattgccgtgtcgcgcatgaagggcggtcttactggtaagattctgctgctgcagggtcctcccggtgttggaaagacctccattggaaagtccatcgccaaggcactcaatcggcagttctaccgattctctgtcggaggaactaacgatgcctctgaagtcaagggtcatcgacgaacatacgtcggagctatccctggtcgacttgttcaggctctcaagcagacacagacagaaaatcctctgattctgattgatgagattgacaagctatcgtcttcgcgaactcagggagaccccggagctgctcttctggaggctctggaccccgagcagaacaacgcatttctggaccactacctggacgttcccattgatctgtccaaggtgctgttcgtgtgcacctctaacgatctgtctacaatcccctggccgctgctggaccgaatggaggtaattgagatgagtggatatgtgcccgacgagaagctcaacattgccaaccagtaccttgtcccccagtccaagaaggagactggtctggagaatgttaacgttcaggtgaccgacgatgccatcaatgcccttaaccgacagtattgtcgagagtctggagttcgaaacctcaagaagcacatcgagaaaattttccgaaaggtggttgtcaagatcgtgggcgagtatggccaggacgaggttgctgctgaaaagattattgacgtggagcctgtggagaaggataaggagtctgctgagaagaagaccacgaagtccaagtccaaggaggtcaacgaggaacctgctgccaaggaggagaaagacaaggcaactgaatctgctgagtcatctgagaccaaggtgggcacgaaggctcctcctgtcacggtccccgaggactacagcctgactatcgatgagaaggatttgtatgactatgtcaactctcccccttactcgtccgaccgaatgtttgaggatcctccccctggagtcgtcatgggtcttgcctactctcctcttggaggctctgctttgtacattgagtgtattctggatggaggtctttctgccgactcatctgctcgactctcgtcgactggtaacctgggtaacgtcatgaaggagtctaccaacattgcttactcgtttgcgaagtcgtttatgatccgaaacttccctgccaaccggttctttgagcgagctggcatccatctgcattgtccagctggcgccatttccaaggatgggccatcggccggatgtgccgttgtgactggtctgctgtctctggctctcaaccaccccattgactcttccatttccatgaccggtgagatttcgctgaccggtaaggtgatgaagattggaggtctccgagagaaggctgttggagctcactctgctggagccaagaccatcatcattcccaaggacaattctggagactgggacgagcttcctgacaccgtcaaggaaggtcttactcccgtgtttgccggcacctaccaggatgtgtatgacgttgttttccagggtctggataccaaggtggccgctgaggtgtggaagaagcaatttgatctgattgaccgaaagctcgacaagcgaggaagcaagtgaggatgtatatagtatgaatgaataatgattgtttagttgtgatcatgagtggagcagcacaagcatgcaatgtaagtatccctttagacaacaatgtcagtcttgacaagttttaatacataatgcctttcttaatatgtgcccatggcatatttctgtcgtaaggaaatgtgtcataactccatgttatcaatcaatgtcagatggcagccctacatgacgccagattgttggcgcgcataatttatatcctctcgctaatcgtcgttacttgtttgatctctcacaacaaagaaagggaattacttgtttccagctgcttcgcttgtttctccacgggatttcttcttctcctgtcacgccattattcttcagatttaccttgcgttgcatcccagctcgcggagcagggtggtcgggggacattgaaaaagcaatgagcgcagcagtaacttacggaagcttacgtgttggtttttttcgttagcgtttccactttattagtctggaggggagccgttgacctacaagtaatggtacaatagtctctcggaaagatgacaatagtggccgtgctggtttcgtgctactgcagtggctacagtattgtcctagcctcgtctgtggatgtccaatggttagtctgaactgcaagtacagttcaagtagtgtccttggtcctaatcaacttaacgacgtgtagcactgtactatgtgtctatgtctttcccgcctccggcacttcgcattagatccattagacccgcccggtagaagggcatgtgaaagaggctggagggggcgaactcaacaacttgcttgtagttgaaagccatgttgtacagtccctttgatggttgataggcagtacagtaatgaaaaactccaactcaatgtcactctaaagtcagacaaggcccttcttcctgttgactctgcaggaatgctccacttgtctcagcagagttgacttttatctgagtgattaagaggtgtataacttcacgctggttttcccagatacttgatttgctacttctggatcaccttgtggccattgccctttcgaatatcgtctatagttgttgaaagaacccgaaatgcgcacaatcaagataatctggtgccgatgatgggctgcctaggcagtccttgtacacactgcacagtgccctccaacacaatcgatacctggattgaaaagatcgacggatgtaaagtgtatccgtcttcttttcctcttctcctatggaatgctgcgcttttgtattattggcgaccctgtcctcgttcggaggaacgacaggatgacaatgagcacaggaacagactcagtatgtggtcacagaagactttgtaacctggggggtgtatcaacttacgcattatgttggtgatatcgaactctggtggataacagcactgctggggggaaggatatgaccccatcatggaggccctcggagtttgttgacatctctgcacattcacaaggctgatgtggttctcaaggtgctcattcaatacacctgttatcctgaaactaactactggccgtgaatgggttatttgcttcaaatctacgactgcctacaccgacaatctcctacgtgcagtgcagtgttgtataagtaactgaagtgttcaggaagtcctcaacgttacctgtgtacatactgtactgtacgatagtatgaagatgtactgtaactacagtacaagtacaagtagctgactacttaaaccgccactttgaagatttatcttcaaagtggtgattttattgttttttaaaaccattgcaatatgtttacctctcgtatcagtctgtctgttctacattgtagttcacatcctcaccaaccacatgaacgtgtcaaaaatgttctctagacactcagcagctttccaatggcatactgtagctactgtaatttatcctccaacgaaaattttgagaagtatggagcatgccacatccgatctagcccctcaccttatctgcatcgagtcacctgaccaccataccagtaaaatagttgacctcaatgctcacaactgacaaccaacacctcccttcacaccaccatgcaaacatagtcacaggactacagaaacactgcaatatgcaatacccctcacactcgattactcacgtgactcaccgcaaactacacacttttccccgacagcttgctgtgcaacgtttttctgcggcgtctaaattttccgtgcggcgggataagcgtcgggttttatataggcttggcatcacagtacgttggaggggtagagagtggagtggagaagttagtggtgacccaaaacataggtaaatgatatactgtagtcgagagaagtgatagcagaccagttgtagcacgcacacaatacccatcttactaatcctgtaccctcgccattactaaaccctgagaaccccaactacacacgtgctcagatagcaattttagacgcctgaccgacacgaagcttgcggtgtgtacaacttgaagcggcagtcagatatgtcatatttggagctaaagatgcaaataaaacgcaacctcattatcaattccacaataataatataccggaaaagtcacgtgcccaaaaaccctctccatcacgccccatccacctgcggcaactgataccactttggattttagctttgtggagtgcatcagctgtgtctactaaccgcgcagctaaaggtcttataaaccacactgcgcaacccagtctcctctgtaagcaccttctcacacacaatgttgcgagccctgaataccgtccagcgactttccagcacccgagccatgtccacctcttccatttcgtctctgcttaagaaccccaatcttctgcgaaaccagggctatgtcaatggtcagtgggtctcctccaagaccggagacactttcagcgttgagaacccagccactggcgagactctgggccaggtgcccgagttctctgtcgccgaggccgatgaggctgtccagcacgcacagactgccttcaagaccttcaaacataccactggacgagagcgatccaagatgctgcgaaagtggtacgatctgatgcaggagaatgctggtgatctggccaccctggtgactctggagaacggtaagtccctcgctgacgccaagggcgagattggctacggagcatctttcttcgagtggttctccgaggaagctcctcgaatctacggagacatcattccatccgccaaccccgccaaccgaatctacacaatcaagcagcccatcggagtctgcggaatcatcaccccctggaacttcccctcggccatgatcacccgaaaggctgctgctgctgttgctgctggctgtaccatggtgatcaagcctggttccgaaaccccctactctgcccttgctctggcttacctggctgaacaggccggcatccctaagggtgttgtcaacgtggtcactactaagaagaacactcgagcttttggtaacgccctgtgcgagaacccgaccgtcaaaaaggtttctttcacgggctccactggtgtcggaaagacccttatgggcgcatcggcctccactcttaagaagctgtcctttgagctcggtggcaacgctcccttcattgtgtttgaggacgccgatattgaccgggctgtcgacggagctattgcgtccaagttccgaggcactggccagacctgtgtctgtgcaaaccgaatttatgtgcacgagagcatcgccgagaagtttgctgagcgaatggcagccgtggtcaaggacttcaaggttggaaacggtctcgaccctaacaccacccatggccctcttatccacgagggagccaagggcaagatccaggagcaggttgacgatgctgtcaagaagggaggaaaggtactcattggaggctccgacgcccctgagatcggaaaggcctttttccagcctaccgtcatttccggggccaagtctgatatgctgattgcctccgaggagacgtttggtcccattgctgccatcttcccctttaagaccgacgctgaggtcattgagcttgccaacaaggcagaggtcggtctggccggctacttctactccaaggacgtgtaccgaatccaacaggttgccgaggctctcgaggtcggaatggtcggtgttaacaccggtctgatgacggagtgtgctctgccctttggcggtatcaaggagtctggctttggccgagagggctccaagtacggcctggatgactacatggtgctcaagactattgttgtgtctggcgtcgagccccacattcagccttaagcaaaaatgagtagtttcaagattaatgatgatgatttattaaataccgtactcgtactgtctgcgtatagataaagcaacaggtgcattatcatcagagtttatttgaggcgcgtgatgatgtagctacactaagatcgaaatccaagtacttgtacaagtacaaagaaatactgtagctacagtacatgacatttatatgaaagcttacagtgagaaaaaagatctgggtgaaacatggatgaggttcgtggtgtgcaactgttacactagaatcaccatcatccagtgcacaatacggtttgaagaccttcgaatatatatgacatcttactgatttctacgtacaagtatttcaagtacaggtatcaattggtaacctcaggtttcctacaatgctgaaattcgtataagatatgttattgatcaataaataatatggtacttgtagttttgtgtcaatgcaaagcatattacgcagccatcagggtgcttatttgaggttggtgaagtcaacctcaccctcgagaagaccagagttctcctcaccctggcgggagcaggtgcaatggttggcaggtctcatgccgcaagagcaggtggaggagacgggcttggcgttctcaacgggagccttggagcagacacactgctgggcaggctttaggccacaagagcaggtggcctcctgggcgcaaatgcaggtggtgttgttcttcttgcagcaggtcattatgaatgtagtgggttgtagtggttgtagatggaagagtgtgtttgattctgttcattttcgggcttccaaggcttccttataaggagctgggaggagctgggggtcatcgcgtgatcgaagttaaacgtgatgactcgaaaccttcctgaccattacaacgattgttattggatgttagttcttcctgtcatattctagaaatgtcagccccgaaaccttatttgatgacctctatgcacacaacgattggctgattttaaggttagtcaggtgatattgggagtaaaaataatttcaactacgatttgccaaatatttaggtcacgtgaagccggacgagacaaaaatgaagatcttcacttagggagtgaaaaagctgggcccaaccgggaattgaacccgggacctctcgcaaattgcctaggacaccctaagcgagaattataccactaaaccatcgggcctcgacgataagatttcacttaacactggaatcaaaatccttgtctctgctttgtcatcaatgtatcattagaataaaaaaaattgtaatgaatcattagaattaaaaaaaaaattgatttattgaacgccaataacctggcttactaggtatatagctgtaatgaatcattagagtaaataaaataacctggcttactaagtatatagctgtaatgaatctagaataaaaatttaaaaataactttaattaatcattagaataaatcccccgtaaccccaatgcatggaagtaattatatggtgtgggagagactgttactgttttaattcacggacattatattattatctatatttggtttaaacacaaatcagtcttacaaatcgcacacaaaaatggtacgttctagtattgataatcatgtatggtaatacgatgtcgtgcattgtttatgtagtgtaagtagttattgtgcgttgtgtatgcagtgtaatcggtgacagtgacaacatggggagatatatatagaacggctttgggacggtttagatcaaaactcatgttaagaaaacaacaactcatcagcaaactacaacaactaaaactaatgtctaccactaccgatattactacacccatttccaagcccattgacaagatcttcactgctctagagacttccgagggtcgaggagcgcgtgttcggcgtgtcatgcctactgggaatatggtgaactttaccccctttcttatgtttgatcatttcaaggtgccctcttctgctggtttcccagaccatcctcatcgaggccaggagactatcacctatgtggttgatggatccgtcgaccacgaggatttcactggtagcaagggtactcttaatgccggagatttacaatttatgactgctggacgaggtatagtgcatgctgaaatgccttctgcgggtcctaatggagaggtccgaactgtggagggtatccagctgtgggtggacctacccaaggagctcaagaactgcaaacctcggtacagagatctgagagccgctgagattcctattgccaaatcggatagcgaggatctcactgtcaaggtgatttctggcaagtctatgggcgtcgattccgtcaaagatcttgcgtatactcctgtctggttccttgatttcgaatcttccaagcagtacagcggacgagaggtcaaccaggatatacctgagggcttcaactcgctgttatatgtcatgaaaggcacagctaccgtcaacggcaagaagatcaagcagcatgatgtggttatattcaagaatggaggagactctatcgacttcatccctggtccttcctcaagagtcattgtcattggaggaaagattctggaacagcccattgtccagcatggtcccttcgttgcaaccaccagaaagggcattgtcaaggcctttgaggactaccagactcgaactcatggttttgagcaggccaagggttggtcttccgaaatcggtaagcggatgaagctgtaggcccacgagtctacagtacgaataccggtacgtagtcaccgaagtcccttactaacctttttatatacctacatagcataaatataaatgaactatcaatagcctatctaaaactatcaccacgtgtagccttatatttctggggcatgagctgagtcgccattccgctacccccttatcccttcatatgacggacatgaaaagaaacctcatatcacaaacagccccttacgctcacgctccagaaagtcacgcagcttacatttgagatgcagcgcttccaataacactatcgttgccaccacaacgaaagtggcaagacggctcttccagtattttccagaagcattttagtagggcaaacgaaaacgaaagcagaactaaagagaaatttcctttacatctacggataattttttccttgtcaagctcccaagacctgtaccgtgctcacattctgatcagatgtaaaacgccacttgagttgttactctgtgctgtgtttggcacggttatactttcaagtacaagtaggagacattgtttgtatggggtatggagagtactcagtcactaaaaaactagccataggacacagagatgatggtagtatcaaaaatcgtcactcacgtggccactgcctcacaaacccataatcaccctccaacttcctgctaaaacacctagacctgttccgcccccttgaaatagggtttaagacacgtgaccatacgcctcttcacgcaggttgtatatatacatccgcagtacgtagcacctcttcgctaacaatgactcgacacagcatggaatccaacgactcgaacgacgtgttattcgacgcgccctccagtccacgtgacgctctggctgcggcttttggaagcgactcagattcggactcggatgatgaacatcatctccagagcggaggacggatgggacgtagctacaaccaggtcgacaccagcacacaagatgatgacgacgacctgaaccatgacgacgatggaggagctactctggaggagctggcgcagacggaagacccccagtacgacagaagcaactatgcagacgaccggttagggggctccaacaacaacggaggccatacccggatccctggaggttttcctgaagctggaaacaccggttctggatcgggaggcaacgctggctccgggtccgagggctccaacgtgttttctaccggcttcttcaaccgtctattcaacagaggtcaactgctgcctacaacagaacctccagcatcatcttcgcacgatggtgtgttttcaaacactcaggccaatgatgacgacgaagataagcccactgacgaaacacctcctacctacgaggaggctgctgcggatgccactcctccttactgggcaaccactattctccaccctggctacgcggaagaggtgtttatcgacggacttcccgtgggctcgcccatttcttttttgtggaacatgactgtatcgtccgttttccaattcatcggttttgttcttacgtacctgctgcacacgtcgcactcggccaaacagggctctcgagcaggcctcggactcacagtgttccagatcggcatgtacatgcgaaacagcggaggaaaccccactacagactactcgtcagtacctgcacaccaatttgtgccctcagaccccaacaacttcgatgtacccggttacggatccaacattccgggaaacgcagtcattccgaccatggagcatgtggaccccacggtgcaggaacaggagcgggccgctcatgaaaagaatgtcttctggtcaggcattatcatggcggtgggaactcttgtcattctcaaagctctgtgggactactggcgtgctcgacgaatggagttgattgttcttcaaactccccagcacgtagtgacggaagaagatacccccgagactgctgtctaggaaaggagggaagcaaatagactaacttggcccccgtcaggaaggggaccattatttattagacactgcatggcacatactgtaatagcatgatggagtacaagcatctgtattgtagactgtttcatattgcgttcatttttgtgagactagaagagtatttgatacaagtactaatatattgatcaatgtaataacgtacgcacgatgttgttttctgttcatctagtcattatgtataaacgtctaaagaatctccatgatcttctcatagatggtaaagacaatacctccggagagaatgagtcgtccgagacggggagtggctcccttccagaaggtcaacaggccctcctccttgaagattcgagcaaagcagtggaaggtgcctcggtattcctttttggcctccaacgattgcattcgggtcttgacggtatccagaggcatggtggtgtaaacagtgacgataccggcaaaggcaccgacaatgaatgtggacagagacgagagaggggccttagggtccttctgccggctctgaatgaacaccttcatccagttgtaagatcccaggcggacagcctggttcgcagcctgtcgcatggtaacagggacaagaccacggtagataccggagaggcccttgtccttgatgagctgtgcggttcccttgaacagaccctggtacttgggattcttactctgtcggtcgtcgatcatggctgtcttgatggtctcaaaaggagtcacagcgacgacggactcaagcacaccggctcccagtcccgctagaactcctcgaggtccggacaccttaccatccttgtcggccagcaggcccttgattgcgtcgaaaccaaggaaccggacaccagccttgacggtattgccgacaatgaaagcggggcaaccagtgtacactgctccgagaccctgggtcttggctgtgttgtagatgagcaccagagggtttctggaggcggtggatgacttgtcaacgagctggagacgggtcttggaccattcgaaagggtaggtaacgagaccctccacggctccggccgtagaaccggctaccagggacttccaaggttcggcctgtgttagatcatgatgcttgctggtagtagttgtcgactatgactcatactcaccttcttggtatctgatgaaaccattgtcaatgtgtctgtgtctgtacttttcagtgggggtgctgttgaacgggctctggatgtgtcagtccgtgtttttagatccgcttagtgtggatatttttcacctgaaaagtctcgaggataacttcagccgtgtttgactcaagatgcgctttaggctcccagcatgtccgcttcggcccgtgtatgcacaccaaaagctggagaagcattggtggaggttgtagcagtagaagattatcttggtccaatttgtggcatggatgtcaaattgatgtcacgtgagtagatttcgaatatcgtatcgctattcacaaatgtcgatgtgctccatcttgccgtacctagaacataaatgagagtacgttcgcttaaaagccagatcaactaatatggatagaataaccaactaaacttcgtgagtgtccacggcagtgtttacagtgctggtatgtatgaaataattgttttgcttccgcataatggacaaaattaatttatataaaaccaatgttatatctctgatccacaaattcgcaacatttcctttatcactgtcgcgtttggccgtatctacagtgtttttatgctcacagctctgctaattacagtgtaatacaatcatgtctttgttaatcgtctcctacatgaatctatttgaacgagttttaccctaaataaacagacgttctagttccaatattaattccatctctctattagtacagtaaatctattccctgtcactccgatgcccaatgcatcccctccaccatctcacattcactcttacctcaattaagttcacgactcgacagtcagacatcaccacctaaagtttcatctaccatcacgtccatcaccacacatccaatgccgtcactaacgccccccacagccaacggagccgtccaatcgtcgtcggacgaagtcacgtccatcgtcattgagtgcggctcgtcatacacgcgtgtcggcttctcgggagacgacctccccaaggtggtcatccccaccaaatacggcaagtacacaaacgacaagggcgaagatgtgtacgaattcggcctggaaaacgtgcatcgacctgtagccggcaaggaaatctacagccccgtgcaggacggttgcatccaggactgggatggagtggccaagctttgggagtacgccatcaaggaaaagctcaaggtggacgacttgagcgagtaccctctggtgatcacagagcagatgtggaactcgagtgcaagacgggccaagatcgccgaaatgtgcttcgacaagttccggtcgcctgccatcagcttcgtgaagaaccctctctgtactgcttacgctgccgtgcgacccaactccatcattgtggagatcggttcggccgtggccagtgtgtctaccgtacttgacggcaatgtggtaaccaaggcctctttccactccaagtttggaggcgactttctcaactacctgattctcgaggagttcaagcgaaagcaggtcgaggtcatcccctcgtacctggtcaagaagaagaaggacattaacgaccccaacccttctacattcctgcgagaactgcccggcatgactgactcgtacaaaaactttgagattgagcgggtgctcgacaacttcaaggaaaccaccctccaggtcaactaccaccccatcatgcctcacacaccgctgccacccaacatccagagaccctacgaatttcccgacggaagcacatacattgctgagcaggaacgatttggaatcgccgagtcgctgttcaggcccgtcgagtttggacccccaggtgtcgtgcctgagggaactctcggtatctcggagctcatctaccatgccgtgctcaagaccgaccccaaagccgaggtccagatggagctacttaacaacattgtcgttgttggaggaactactctgctcaacggtctgactgcccgaatccaccgggacatggcccagttcttcacccagttccatgtcaagcagccctacctctcggtgacctccaccgagcgaaagtcgctggcatggaccggtgcctctgttttcgcttctctcggcaactttggttcttcctgggtcatcaagcaggagtatgaggaacagggcgccgatgtcattgacaagcgtttcaagtagagtagctgtagctaacgtgtattataatggtattggatgttttgaatcatgcagtatgtactgtatctaccagtacgtatctagttactcgtagtctaatgtgtataaaaaatctttgttatatgtacatcacctgtagtttttcttcgtctactcctcgtcaaagtcagcctcctcaacagccagctcaacatcatcaaaatcaccctcatcatcgtcgtcatcttcctcatcttcctcctcctcatcctcggcacgctgcttggcttcgtattgcttgtagtatgcggccagagcgtcctcttcctcctcctcgagcttgggctccatatcctcggccttgaccttgggagccacttcctcctttttaacaccctcctttgtatccttcttctggggatagtcatcgtcgttaccaatctctgtgaatccatgttgctcctggtcggtatcccccattaccatctgtcgaccaacagtagactccatgtaccatgcgggaagggcgttctgttcggccagcttagccttctcatctcgctgggcagcctcgtcctctgcacccgtggaaaggttgacggtgagagtggagcttttgttggagcccgtctgggacgaagtagtgcctctgccagcagtcttgatagaagaggtgcttcctgcagtgacctccagctgtgcgggaaccgccttggcaagcgacgtctcaaaggtgttttcggccacctggatgtcgtctatctttcgtagctcgtctataatgggcttgatttgctgcatgagcttttccagtcggtcctggtgcactctggattcgtcactggtggtatcttcgacaatcacggtagaacagacatcacaggtgaaagtgccgtccatttgcacgttggtgacggcctcgagggtagtgaactttttggtacacagcggacacacgtatccctgtggctgggatttctttccaagcgcctcctctgcctgcttgttcatggagtgcaccttccacttgatggcatcgatagtcacagtgtagtggatgtagtagtacgtcttttggtaatttttgttgtagccgtatgtgttttcctgctgctcgcgctgggtgtgatccttgagcagcttgtcgtccttgagctttgcgcaaatctgtcgaatctccttggccggaatgctcagcagctggtgcagttcctcgtctgaaagcaccacatgcttgagcagcgcgtccatcaccaggatggactttgtgtcgtaaaagcctcgtgtaacgtactggaggagccgcttgatgttgtccatgctgtgttaatttgtggtgttggttttttcttgtgcccgtccccgaagctgctgttgtatgctacagtactgcctgttttatcccgatcaaagttagtcaaaccgactgagagtgcgttcttcctgcatactccaacatgacgacggatttcggcggtggcacaaaaaaagtgagaaccgagcaggaggaggacctggcgtcggagtttcctacgaagctcacgatagacgctcactccgcaccctgcacgacggcaaaaatcagcccaaacggcaaacagattgcaacatgttctgcagacgcgtctataaagctgtgggacgctgctactggagacctgatacagacgctgagaggtcatcgagcgggaatcaatgacatcagctggtcgcctgactcgaagatgctcgccacagcttccgacgatcgaacgatccgaatttggtccacacaccgaccttccagtcagcgtatcctagtgggacacacccactatgtgacatgcgtcaagttcaattataagggcaacctagtggtgtccggatcagccgatgagaatgtccgagtgtgggacgtgcttcagggtcggtgcatcatgaccctggcggcccactcacaacccatctcggcggtcgacttctcatgcgaaggaaccatgattgtcagtggatcacatgacggtcttatccgaatgtgggacactgccactggccaatgtttgaaaacaattgtcggtgaagaatcttcacccatcatgtttgcccgcttcactccaaactccaagttcatccttgtctctaatatggactccactgcaaggttgtgggactacatgaacaataaggtggtcaagacatacaagggccacgagaatggcaagtactgctgtcccactggctttgtgtatcgtcaggatcgagccgtccttttgcatgcctctgaggacggtcgcgtctacgtgtacgatatacaggatcgaactgtgcggggctcgtttgacgctcatccgggagttattatttcactggatgttattgataacaaaatcgttacctgttcattagatggctcagtgaagctgtttgagctggtggaagagaacagcccaagtgacgacatggatactgataccgaggagaatggctgccgaaccaatagcagtgaggagcgggacaacagcagagaaaaggaggacggcaatggagatggtcatggagatgttagcatgaacaacgactagcactgaatatggtgcttaaaacaacacgaaaggtgctgtctactacaagcacacagcatctacgaataagtaatatagaataacagcataatgactaaacgtacagtagctacagtaggagtacagtggccactcgaacgcacctacataccccagttcaaacatgaaccgtttaatttatttatataatgcactacctagtacaaaccacctacgcctggaaagcaacgttgtcgacgtttccagccatgagagaaacaatgttctcctccagtctatcagtaacagcatcctcaagatgcttcttggggtcctgctttccgacatatcgagtcttgagctggtcctcggtcatctcctgctcctcctgcactcggttggtgtactcaatggccagtttgaccatcttctgtgcagcgttggcgttgttgcactcctgggtctcgtagttctggatctccagaccagaggtccaactgctcttgtgcaggttctgcagcatcttctcatccaggggagttttcttgtagttgatgttaatggagtagtagtgtcggttcaggccgtggatcagggcgtggattgtgggcttgttaagatgacccacgttggaggtcgacaatcgaggctcctggcccaaaagcaccgagtttgtgttaatcagtcggaaggcgtcaattacaaccttacccttgaccgactgaatgggatccaccaccactgccactgctcgcttgttgagctgctcaaacgattgttgggtgttgatatccacagacgacagccagcagccgaaaccgggatgtgaatggtaccatccgacgaccatctgatctcgaccggtctgtttaagcatatccatcattcgtgtttggaacacatcatcaacggcctcaacggagacaccagtaccactctggggcatggcaaacacatcaatgacatgaactgtgtagtcgtccacaaactctcccagcataagtcccatctgttgttagtattgattcgttcaacccatccccctcgatctgctgttgccaccattgtcaccacgttgtggcgtacaacagccattgtcgaatagcaccgcgttcattgcatactcaccacttccatggggacaccagctcgtccatgcttcagcatcttcaaaagagctaatgaggaaatgtagacagtctctgagttgtcgaccacaggtccatcctgttgttagtactatgtttcatgagtcgtttccaattcctggacataatcaaaccatccagctccgatcatactcacacctcctccaacaccgggaccaccgaggcccccggtctgtagcattcgctgaaatcgctccattattgatttttgatctgtagttgtgtcgtgtgttaatctatcttggtgatgtatgtgtggcaaagtacgaggttaactcgaaattatggtttgttcgattctcgcctgggaggcgtaggaaaagaattccatgaccttccggtggcgatataagtggataaataaatgttcaagagtaaatatatgtcacatttactctctataatgattgacattactccctccatgatgtatgtactcataacctgtaattcgtactgaacttaatgtgcacaggttgtcatatcgtctgaacatacaaaaacgccatgctaagagcagttaggcggattccccggagtgtggggggcacacttgcggcaaccattcgacacaaatccaccggtctgaagttcccagcttctgaaaccgtcgtaaccaagttttcgtttcctagtcgaacccattccatcaccggtcttctcaaagatgctcctgcgctggagcagagccagaagaaggtcactctgcagggctggatccacaagaaaccccgaaaggtatccaagaacctcacttttgcatccctgagagatactaacggagatatcatccaattggtggattccaacagtccttcgatgcttcgatctatgaagcctgagagtgcagtggtcgtggagggtgtggttgcgaagcagagaaccgccaagaagggagtgtttgatctagtggtttcttcttcctctgtgctcaatgaggccaacgagaaggggagtcagctgactctgggtgatacaaaggattggcctgcagagtaccgatacctgcaattgcgacaaccccagcttcaggctgctctcaagcttcgagccaacgccatgagggcctctcgaagcgttctggataatcttgggttcacagaggtcgagactcctctacttttcaaatccactcccgagggagctcgagagtttctggtgcccacaagaaagcgaaacctcatgtacgctttgcctcagagtccgcagcagtataagcagctgctgatggcttctggtgttcatagatactatcagttggcgaagtgtttccgtgatgaggatctgagacaggatcggcagcctgaattcacccaggtcgatatggagatggcttttgccaatggagctgacgtgcgagaggttgtagagaagctcgtgctcaagatcttcgccgatactgtgaacaagaacatctacactcttgatgctaatgaaaaccttgtgcagcagtccactttcaatcccatgactttcaaagaggctctgggcaagtacggtattgacaagccagatctcagatacacttgtgccattaccgatgtctctgagcatgccacctcctttaatgaggacttccccgtgtgtgagattctgcacgtcaccaaggagaatgctcctgagtctctcgacttcctatctgaggctcgacagtacactaaccgaattcccgacgtgattcaaataactgaggagaacctttcgtcctggaaccagcaagtttctcagtttaaacttgacaagacacttcctgtttcagttggagatgttgtccttgcttctactagacaaactacctcatacgagaatcccactcctcttggacgtgcgagacagttactgatcaaggagtaccctgagaaatggcgacgccaattggcttctggggagcagcttccctcaattgaagacacctttgtggcctcttgggtcattgactttcctctcttctctcctagctcgatggactctgatcctgaaaaatcgcagcccttccccaagtttgactacactcagattgtggcctcccatcatccttttaccatggctgttcttgaagactacccccttctggaaacggatccactgaaggtccgaggtcaacactatgatctagtcctcaacggcgttgaagtggggggtgggtctactagagtccacgattcgcagctgcagaactacattttcaaggagattatgaagatccccaactctgagaagcttttcggacacttgttgcgagcctttgatgtgggatgtcccccccatgctggttttgctatcggttttgaccgtttggtcgcaatgcttgcaggttactcgtctattcgagatgtcatcgcctttcctaagaccgtcactggggctgaccccatgattggcagtccatctgctgccacctcggcgcagctcgctccttaccatgttcgagttgctcccaaggaaaacaaggagtaatttgagatgtacaagcatgatgctcctgttcaaaataaatgtgtgcttgtacagtacaagtacaagtatttgtatatagtaatagaacttttagttattcgagtgttgtctctctgtgttaattttgcgtacaagaattattattgtgctggtccaatggatatcctatacagaaccttcagtttttgaaactctcaactgagatgccaaaaaaacacatcaaaccatcgcaacttgttggattcaacggaatatgaacgtatttatattgattttaagaactacttgtacaagttttacgtacaagtacaagtagaagcgtacaatacctagatcttcggtggaagctcttgcccagttctacgatgatcttggcgtcttgagcttaaagatgcaaccgattcttaccgaagcgcatgccgttcatacaagtagcatgctgatgtctacgatccagcgtatcaagaatgagggaacctcacccaaactcccctcacctgtacatgaagcaatgtagcacagataaccaagaattacgaactcattgtgccaaattcattggaatacccttccaatgtctgaacacgctacgcgtcaaaaaaaacacgctatgatgtactgattaaccacaggaagaattcttatggttgtttgttttgcacccaccaacgtacctacccccacctagtcacagtacattcagcatatagtcaatgttagcattctttacgtacgttagtcagtgtaccatctaccagtggatgattttgccctcgtcctttccaagctcccaatttccagccagtccaacattctcatcttccgagttatcctccaggttctggaccttgtgcttgatcttctgtcgcagatgaacagcattcttctctcgagtatcctcgtcttcggaagaagagtggatcttttccgtgggcttggagatcttggtcttcttgggccggccagcaggtcgctggtagctcttgaagttgtccgacaagattcgcttaccccaggacgaggcggcggggtctccagtctcgtctctagcctgcttgaggaagggaatgagagcggttcctccagtacctcgctcagggccagcgggagcagtgagagcaataccggtcttggccttctcctttgcttgcagaatgatatatcgggacacaatctggatgtgcttgtctcggaaagatcgcagcatggccagacaggcatcgtaggcaagaacgatctcggggtgctcggcctgattggccaggacaaagtcccggatctcagccacctgctgcaaatgctccaggaaccgtctatggggaccgggcatgtactttcgcatctcgtggatgaaattgttctgcttggggggagcagtggcctgagaagcaggaggagaggcatctcgtgtagagttgtccttcttggaggtgggtcgctggccagttgctcgatgctccacgttcagaagaatatcgagagtctgaatgagagaggactgcgcgttagaacctccagcgtaggcccggtactccttagagtcagggtcagctcgagtctgatacttgactccgtgaggcagacctcggtctgccatgttctccgaaccactgaggtaaggtcgcagtcggtggtagaaggtgtgaggctcgcacatctcgtacatacgtccaagcagagtgatgatggcgtcgatggcctcagcgaggtactgcaggttggaggtaacagtggcaaagtcgttttctcgggcagcagcgatagcgcccagaccggctttgatgcaagcgcctccctgtcgctccatggtggtggagaccaagtagaaccacgactcgtcaaaggaaccggtgtatgtggtgatagtggccagagagtcgaggtcccactggtcggaagaggccacgggcatgatggtcttgtggttccacagacacagaccggcgtatgtgcaaacagggggcagttccaggaggtcggagatggccacccagggctcggtgatctgaggaggaatgtagtctcgagggtcatctccaggcgagccccagatataagcgtgggcaatgaaactgagcaccgagtatgctcgtcgctgttcttcgggggttttgagctggtcaatctccagcacgggcattcgtgtgtctacatactgtctaattcgtcgggtgagaatcagagcaggaaggttttgtgccacctgctcccagggagcatagtaggggttggtgaggctttcaagaggcagctgttcgggcaggaagcctgtcttgtcagagacttcgtagtctgcgaggttaggaagagctgcgtgcatgttgtgagtgggtgatgaagggttaggtgttgtgagtgggcgaggtgactgtgtttgtggcaggaggtgtagttagtacaccgacttttcgtgtcactttatagatgtgaagtggtagtgtgacttgacttaggctgtgtggtggtgagaagctaagagcgctgcactctaggtttagatgttggaacggggcggataaggtgtaagggagagttgcggctgaggaaaaaagagggtgtagaatgtcgaacggcagaagtcaaacgaaacccttaaaaagaaccacgtgccagcaactaccatatatgagaggattgggggcgttcaggaagtaggaaataaccagacctccagctctctgctaagccaccaccagagctcactttcttctgccgatgcactaccacctcaagtcggctcttagcttctccgagtaatttttcacgctagtaaatacgcaagataggtgacatgctaattattagcgcagttgagcatggtggagtcaggcaagttactttgaaagtacggagcatctcacattgtaaaataccaataataaatacaataaaagtgcagagatttccacgatactgtacttctagcgtcttagtaacttttgagcattaacccgcccaatatgcaattaattaaagccccgcattgtgtacgagtagctacatgacgtcagcccatacctgtgtcatgccagccattcacaccctctcaatatggtatggttgctcttgagcagggcacactaatgtgcaagtgtccgcgaaattgccgacgtcgctgctacgacgcctttagaccccagataaaccaggtggaggctgtttccagaacccaggcgtaaaagctgcggtttcggctttgcatccgaacgtgcggcttgcatcactagcgtgtagttctgggaacgttacgatacataccgtaccgatacatacagtacgttcgacattcctactatgaccagagattgcgggatccgtatatagagagcagccgaccgtgtatactgtaaaactgagggcagctcacaggctggtggtcagatatgtactgtgaaccttcgataaccgcgatactgtctcagaagctcactcgagacagagtctacgcctggagttcacgctatcgtagtgccgctagccgaggatacccgggaagctgaagtaatttggtaactaataatactggagtgtttgctatttgtagttgtggtatttggcagagtttcagtgagaagattgaatgtggctgctgccctgatacttcaacagaaacaacagagtatgtaattacaccgtcaattcattctcacctctctccaatcttcggaatggcacactaactccggtattcaccgttccgtagactgctctaacattgcggggttgcccaacaaatgatccaggggccattagccgaagggtcacgtgcattcaaaacataccccctccgtagagatcacgcgtcaaccaaacaagactcaagggtgtgaaaagtcacgtgccctcataaccgtggcttgatctaaatcttactccctgtgtgttgtcgtaatacttaatgctacagtactttttttcataattatttcataataataacaacagtacatacaagtacaagcacacaagacacgctgggggtgttttaccataccaatgaagagtacacggagaatcaggccacaatacgatctgctgacttttgaaatatccccaaaaatgttgaccgttggatcagctgattacgactcaaagaagccctccactccaacgtcgactactgtacagtacttggtgtcaccatccccgcgatgagctacctcatagagtttcatattaccccatatctacagttggtgaattgtaaatagagctagatatgctcaacaaggacttgctctgctagtttcatccgacccgtcacaactcccacatgctattatttgagctgttcgaggtatctcaaacggtgcaaacggtgcaattggagcaggagttccgaaatcgcctggttgattggagccacagtgtcgcgagtttatgtgctttaagtattggctatcaaatcctcagtaaccctcaatcacgcgaaaggtacattgaattgggcgacgagggtgcgtccgagctggtagatcagattgacgacccgttgaacttcctcgaatcatgcttctacggcttttatcgaccgcaaatcgtcgatccagtgccattactcaaggtgctacaggaccacaagaaggaaagcaccagggcggtgttctcagggacgcaagatattctggaaaagttctaaattacaaagtcacaaaagtccaaggactttggaatcctcgaatggtggacagacatgcttaatgttgatcccgagggggacggagaagcagtatcaaaggacaaagagtggatcgcaagagagcaggaaagacaagagacagataagtcagaattcaaggggttttcggaaaaattcattcctcacttggaaaaccagctctcgggcctattacagaatgaagcctttgtttgggagactatacgaactctaggatacggcctgatgctggaaagtcatagactgcaacacttgaagaagattctgttcgttacccactgtgaacctcctagaaggtactggagcctgctacacgcctctctcgtcagactgcgaagaacagccctttactgggagactaaaaagatttcagctaatgatagtgtcaatatggcgctcactagagcagtatacgagagtctgctgttgctactggagaacctatcgaaattggtgaaacatctcagctccaagtactcaaagaacctatgccagatagctaacagattgtggattattggtcataccatggttcgacaaactaaccatccaggcataccatacaattctgtcttcagtgatatcactgttagaacagcatatattgagtacttttacgccaaccgagtgctttcaaagaacttcaagccgttccattactcgttccacaccgacgagtattatccattatatgttattgatattgctcttgacacggcagagctggagtggatctgtccaggcaactttggagacagggaggctgaaaaggagcgaataagagattggaagtttgctcagaagtaagaatacatacaaataaatttcatattacattagttaaataaaatcgcacagttaaaatcgctcagtatttcacctattgcacgtacccggccatggtacgaacacctcgctgagtgaagtctgtggggttgttgagcagccagacgaagtcagagaaggcgcccagaggcatgtagtcgtcggaatgggcagcttccaacagcttcttcatcttggcggtgtgctcaaacttcttcgcggcctcctcagcgttatcgacaatgctcttgtcaataccgcacatggcagccacatgcataccgaaagagccaggcgacgatccgggctccaatttgtacaggaaggtgatctccttggacgcctcggacaccagaatggccattcgcatgggtcgcacttgagggtggtgtgtgaatgaagtgtgcaacgtaccgtaatgcgtggcgaagaaacccagacagcccacctgcgtagccacatggtgaagcacagcctcggcaatggcaaatccgtcggcagacgaacctcctcgtccaagctcatccagtacaataagagattggggagtagcgtcaaatacctttttagtttcactgagctccacgtagaaagtagatttgcctgcgaagatgttgtcctgggctccaagacgtgtgataattcggtcgatgggagttagacgagcagatgctgcaggcacatgacagcccatctgagccatcacagcggcagtacaggtcattcgcagtaccgtagacttaccagcggcattggcaccggtcagcagagtgatgttagcctcatctccaccaagggacacgtcgttgggaatgaattgcttggtagagtcgaagcagggatgtcgcagcccctcaaacttgagagtagcatctgttcccgaaacatagggcacaaactcgggccgacaagagggagagccgagagtctgagaacacttggccagagaaagcagacagtccagctgagcacacacctcaacgcaccgcagccacgagctgtagtgctcgtcgaactgggcgtacatccgtcgctccatggccgcctcgatggtcttgtggtcttctcgcgcctccatcagttttcgaaccagagccttgacctctggactccagaaccgcttgaccttggcggtaccgctcatctgttgccacgagttgggaatctgcttgacgagcttgacgggcatctcaattagatagatctccttgccggagtcgtagaacttaatctcctggctcttgtactcctttcggtactctctcagcttgaccatgagttcgtcctccagacccttgatggtcccttgggaagcatcaaagtccgtttccaccccaggctcggggatgagaagaccttccttggccttttgtctgtcaaacttggtatcccagggaaccagcatagtctccagattgggaagagactcgatcagagtgcgaattagaggagcagactcgggagccttctcgctgagcgcagcaaccatgtggtacacctcctcaaaaccctcgacgactcgaacaaagtccttaggcatgattcgaccagcatgaattcgggccaacagacgctccaaatcaggaagcttggccagccgtcgctcaataccgaaatcgtcctccatgaatgcttctacagcgtcaagacgagcctcaatcttgacctgatcaagcaaaggaagggcgacccattgctgaagcagtcgctttccaaagggagaaacacacttgttgagcagcttgaacagagtgccggcatctgtggagtcgtaagagttagcaaaaacctccaagttctgcagactgtgaccatcaagcaccatgtactcgctctggatgggctcatagtcagaaaagtttcccagagagacaagctccttgtccagcttgagatactgcatgtaccacagcagagcaccaaaggcggacatgcacacatcgtcctcaatgaagctcttgagatgttcagggtagttggacatgtcgtccaaatcctcagcttcaaagtacttgcctcgtgtgagctgctccatggcagtggtggcgtcccagaactcggccttggggatcaggtagttccagagagtattaatggtggtgtttcgcttgaggatcttgacgacagccttgtcgatgatacctttttccagaagaacttctccaggtcgaatctgggctaccagagtctcaaacttggagaagtctgcgtcgtcctcaaacgaagaggtgtggaaggctccagaagcggtatccacaaatgccacagcaattcgagagccttcctgcttaacagccatgcaataagtggccagatcggtagtcagcatcttctcgtcagtaagagtaccgctggtcagcaccagagagagttctcgcttgatgaccttgtcctcctttttgagcgtggcagtttctcgcatctccttggcgagagcactttccttctggtccacacgagcaaccttgtgtccgtttttgatgaacgcgttggaccacgagaagaaggacatttcgggaactccacagagccgcatgttggctcgtccgcctccagcgagcttgagatcaaactcagaatgagcaatgtctgcgtctcgctcatatagctcgtagaacttgcccttcttgaagaacacaaccgtgttccacatcttactcttgacctcccagtactgcttctcgaaagctgtgaacttactccaggcggaagaaggaatgtaaagggttcgggggtcgtagtcaggagaaccttcgggattaccctgggcatccttgatatcaataagccacttgtaacgctctgtgttgtttttggcaaactctgagtgcttgcctcctccgttgacggcagcctttttggcagcaggtcgtgccgatttgtcactagtgtatgaagacttggccgagaactttgccagggcagaagagcctgattgagaactcttgggagaggatctcttcttgacagccacaatctcctcttcgtcgtcttcgtcggccatttcaacgtcactgacatcagcctcgttcacagcaccctcaatgacatggtcgtcagcctcctcttcactgggtacgtatccgtcagtgtcactgtcgtcatcaatgactcgtcgtttggatcgagtgggcttgaaggctgcctcatcctcagagtcgagatcgagatcgagatcggaatcgtctagttgaactcgttgttttcggtgcttggttagtaacacttgattgaggagtatgcgtcattgtcaaagccgcattgacacaatggcctcaggttggtgcaggctcacacgcaagtcacgctccgagagtacaggtcgccgcatttggccgtcaggtatgagcagccttgtgactttgctactcccacaaaggcatctgccatagtgtgtgtcatgtcacacatgttattctcagcccctgaccttcagtcatgcgctagcgttgcttccgtcatactcactctcttaacaggactgctatgctcctctccatcctcgaattcgctgctaggagtgggaacattgccggttgtgtcgaacttgggtggcggtctcgaagagatggttgtggcctcaagggacttgagggtgctcttcgtgacagtctctggagtaacaggggtggcaggagacgtcttctcatctacgagcgtgttgtcactggaagtcgtcgtcttggtctcctgttttttggtctccttgacaggcgtcttcttgaagaacgatagcaccgattgctgcttcgctttagccatggtgcgtttttatggtgcgtgttttgtatcggtggtgggtgtgacggttgagagtgcaagcctcttccaaatgatgtggtcacagtgtgcgtcgtgcaaccttagacgcgtctcattaggctggtcctgcgtcaaaattgattttttgccagtgttaattattcacgcgtcgcgtgtgaacgggagggagcatttaaaatgggctaaaaaggtctgcacaaatgcaatcacgtgatcagaaacacgaaaaaaaaaagacattaaatggggttgtcactaaaacatttccgtgtaaacattcccacttgactggtacaatgtctccttctctatacagtcttacacagaacgctccaggctgaaatttttagggttggctgtacgtgtttgggacgatgaattgctaaagggggttagcagaaccagcgagtacaagaggtactggattatggagtgtcgaaagacacaaatgagttgaagaggttagtattgttaactagatggttctccccccagttttcagcttctctctgggtcatttaatggccatcatacgctgcatcatcaaccaaggttcggtgtatccaacagacaattgcgatgagatttcaccagcagaaaatgagaactggtgtctaccaataaggatatcattggttacccgtaatactacattagatatatttatattcaacagttatctaagagtcgtctttaatcattaatttcatgtctcatatcagttcagtcattgacctgaggatgcgaccctgtttgataaaattacactgatttgctcccgtgcaatgtgcttgctcacgggtaattaagcccaatcagtgcacgcaattctctgacatcagctcctatatctccgcaagagcatctatcgtaatagtactcacgtgaggattattctagggatccgtcactacatgtaccagtagcagccgcgatatactgtagacgctttccgttactgtaggtgcccaccaaagaagcatcacacatcatacagtagtggtcagaaaattgtgtatcgttatgtgcgtcgtttgataggtctcactgtgaggagctgcgaacgggatctattggtacagagccgaagacatgtagcttagctaattgtagcttggtaagtaacggccccttatcatctaagatgcgagcagacgagagagtcggcgtagttatcagtccacttctacccatctgagcgctgttttgttagtctgatgtgagcagctctctacaatatgtacaatatgtactcttactctgttatcgtgcctctcatagctgagaccacaagagttgatacgtcagatacaaacaagatattaatcatgctaccaaactacaccaattgcaatactatccgattagtcatctccagagcaagttctggatctggtcaacatgtttcctgatgtgcactcatctaccagcaatactcacacgactgtatcacattccgcttcagatcggatgactgatgttctaatctccaagcccaatcacaggccttttcgccatgcaatgaggtgtgactatgcctcatcgtagcccaagagtcccctgactcaccccacattttctctgcgccgatcatccgaacgttttcgtcggcttaatcacgtttcggtcccagagtctgttcatgtgggggagatgccgacatcggcgagacgtcggaggggactcaaaatggggctaaatgagaggggaaagatgtaaatccattatttagacctcaaaaaagagctctatgttcttgatttccccatattaccttctcccggactacttttaaccggtgttgtggctgaataacggtcccgaaatccacccgagcttatcagggagcttatttcgcctaggacaggtaccctgttgtagggcacatcttaactgttataaagagacctccaccctcccagtggcatcaccccaaccaaacacacacacaactcaatgaccactgcactgacccgatccgcacgactgctgcttgtgggcgctcccggcgctggcaagggcacactcactgaccgtctgctcaccaacttctctggtttggaagcaatctctaccggtgatttgctgcgacgagagatcaagaacgagagcaagattggcgttgctgctcgatccatcattaaggccggagggctggtccccgacaacacaatcagccagctgctgcagaccgagctggagaccaagggctggctcaatgctgacagctcatggatcctcgacggcttccctcggaaccgagcccaggccgaggtgctggacgagatgctgctgccccacaaggccaacctgtcccatgtcgtgcagctggacgtgcccgaggaagtgattctggaccgaatcgagaaccgatgggtgcatcttgcctctggccgaatctacaacctcaccttcaaccctcccaaggtggctggcaaggacgacgtgactggagaacccctgtctaagcgagaggacgacaagcccgaggtgttcaagaagcgacttgtggcatacaaacaagagactgagccattgttcgagttctacgagaagcgaggcgtcctggtgactctcaagggagagacctccaacattatttggcccaagctcgagcagctcatcaagactgagtactgttaagagctatcaatacttttcttaacagagctaacagggtctaggatggtctgatgctaaaagactatcacggtagatataaaacgtcaattgtactggaatgtacggacaatgcataagcatcgtatagataatgaattcatgatatcagttacacatttgaaccgaaacggactgtagcgaattaaagcggaacaacaagataaacatttgcgtagcgagtctgatattgtcgtcgtgatcaccacacatgtccaatgtatactaatagacacacactattcccaacattcgatctaacccaacaggccgttcattgagttcaaagggtgtatgtgacagtgtctatggaagaatgaagtatcatgacacacgatcaagtgatgagaacaggagtctttttatgggagctatgctttattgtaaatcttacaattgtgcctttttctaaagcttattgcaattattgtgagaagttactgtacaagattatcacgtactcctactgtactcgtaggtctgtcccaacggataatagtgatcaaggatcaccacagcttattgaatgtttaacttacagaagagtttatggaagattgagagctgggttgctttacagagagttattgaatagaaggaaagatcgtgggaaacggataacgtagtcgtctgctaaggcttccaaactgactcggtaataccctgcttggcgagggcatccacctcttcgttctctccagcgtgacccggaatgtgtttgaaggtgattcgggtcccgatccgagttcgcggcttctgcagatactcatcgatggctagaatgagatcctggttctccacctcctttcccttgccggtcttgaagccgtttttcttccagccctccagccactgcgagcagcagttgacagcgtactgcgagtctgatcggatctgccagttaaggttttcacctctgttatcgatgatttcgagggccttcaaaatagcagacagctcagctctctggttggtctgaacgtctcctacgagagggcccgagtagttgcagggatgaagttctccaaagtagacaccgatgccacccttgggtctgtgtccaccgttgttctcacatgcgccatctgtgtaagccaaccatgtgtaggcgtctgtttcatcatcaatcagaagtacactggtccaatgctcgggtgcgcaagtgaaggactcttccatgtagtcctctgccttggctcgagtgtcgaacttcttgggctgtgagcatggataattttcggcggcgtgtagtgctgcattgtagctggtataaataccaggcttatggccaactctgacagcatagtagggtccattgtcggcttgggctgtgtgtgtctgtgtggtgactgagacggaaggcatgaaggcggttttagacattgttgatgtggtgaggtgaggtgaggtagtaggagagagggagcgggaagacaggttgctagacttcttaagtgcacacacgagttccccacacatgatcaccccacatctacaacaaaccaggagaccgaactcaatttgccgtttatagttgcccttgatgttgacgaagaaatagagggggttaatgtgggtgggatgaacacacaattggttgaaaaatatgactcgtgcgcctttcgtagatcttgaatcatcattggcctggcctttcgtggataaatttctgtctctgccaacttcgttgggtggcaattgcaaaaccccacagtcccctcatgcacctcattgttatcatactctatcatgcaagttatcgtgtgcacccgaaccttgtgaggggcttcgaggcatcacagagtgccacgtcgaggtatcgtagtgtgggagaggtgggatggattctactggggtatatattggaactcgagcttttataaactatacgtccaaagtcgcaagatttcgagggagagtgaattatgtttctgaaaagcttgtctaataatatgaaggatctggttacagtattgctagctgaaccacttgaaaatatgtagcttgctcatagttaccgtatgtaagaaactaccaatattactactcgtacaactatcgtacaattacaatagttggagtacatactgtacacaggtcatgtgaaccacagttgatggggatgacagctcctattatacctcttcgtatgctttcaatgtgtcgcttcaatgcaacggtgtagataatatctgtttaagatatgcaggggaaattgcagtatgtaccagtactctcactgtacttagcaaaagtatccctgtctcatgagaatcacagtatcctattgtaaaacaagtagctcatcaaccaccgttgatgttgctgcagtgctgtgattaaaaatctagaccaagtctggagcttgagtctgtactaagaccaaaaatttattggcgcgagggataatgtagctacaagtagcaatggttgacaaacgacgacacatttcgctctaaacgccaattctgagaaaagagccatacatgcagataacaagagactattaacaacacgtatggctggttatctaatgtcgatacggttagcgctacaacatctggcatagagctattccagacatggatctcggtgctcaaactcttcagtcactttgacatagattcacggagagacaggccaattgtgacacgcacacagtctgtaccgacaactttccagccttccggttactccctctgataacactgtccaagtcctttgatattctcactagtacgagagacagcacacagtctttcgcatgatacctcaattactgtatatattgttgcactaatagaatcaaatatcctagagatctccacatagtttcactgtccagtaacaagaccatctcgcggattgttgtatctcgtactgtgcagtagctgcttagctactgttgctggataaaacgtggtttcctatagttaagagattggtccctgcagctttaaggacctcggtcttaaggacctcggaattgttgggggactttttcgaagctgaccttgacagaaactaccagactggatcttctccaacaatttcaaacctccggaagctccatcgtgtcatattcgttcctgatacagccagcccgagtcgctgaaggactatagttccactgcttcattttcggagatacttccccattggtgttctccaaacacatgtgcacgtctcaggtacagcatgagtagtacatactgtacgggatagctgatgtaataacacgacaatatggaccagaagaacacatcaactttatgcagccctagagcgtcaaattactgtaggaagttactgtacagtactcgaacttgcagctctcactggcgagcaaatactgcaagttaatacagcatgggaaaacacaccagtaaccaagttatcagcaattagccttaggttggagctagtcagaggaggaagaataatggactatagatgtccctgaatggtgcgcacaaacggggggacagaaaccgaacccacacaccgtacacgtatctgcaactcaacatcaccacggacacggatcgagaaccttggaggctgccaagccaattatttcaagaaacaagggccagacgacagagtccaaacacccacgtacaaggaccaaaaagtcagggaggacagagtcgaacttttttttgcttgtttctattgcctaaacgagcaaaaatactcgtatgacccctggttggcgccaatcatgctcataatcgctctttattgcatctgtcgggtgcatttaagctgctgcagctctgcacggctggaactcttatttcccaccttaacccccagcctctgaccaacatcccaaccgtctattgtagatagactactgtagctacttattctcactacaccacactttgtaatgtgaatttacactgggatagcaccatacgatactatacaaaaaagggtcagttggtatcttcttcaaaaggacaagaccaccacccctaacctacgtatgtactcaacctgcatgactcggctggccttggcagcatcaaagtgacaatggattcctgttacaggcacacaccttgtcggtttaattgctcgtgagttcgtccggtagtgagatgacctgattctcgagcacttatatataccttccttggtccatggaaaaaagaccatcccaatcgttcaacacacacaaacaatgaagttctctgccattgctctctctcttgccgttgcctctgtctttgccgctcctcatgagggccatgaccatggtgaggctgctgccccctctgttgcctctgccgccgcctccgcctctccttctggaggtgctcacaaccatgatgaccatgatcacgaccacgatcatgaccacgaccatgaccacgatcatgaccacgaccatgaccacgaccatgaccacgaccatgaccacgatcacaaggattctgcttcggccattacctccaccgctgcctctagcgttgcctctgccgctgcgtccgcttctgcttctgcttctgcttctgcttctgctcatgaccacgaccacgatcacgatcacgatcacgatcacgatcacgatcacgatcacgaccatgaccatgatcacagctctgtcgcctctggtgctgcttccaagactcagcctgcctccgggtctgctgctgctaccagtgctgccacttccagtgctgctgagtccgcggctgccactagcgccgccgattctgctgcctccggatctgcttctgcttctaccacccaggctaacggcggagcttccaatgtcattcctggtgccgtggccttcgttgccgttgcggccgctctcctttagattttccccaaaacgctgacaatatagttgctacttaatgaaattaatataacaaatacatcaacgacttacatataacttgctgggagggcgtcccgatccaccttactattctctctaacagagagacacatcaggacattctccacaccctaatggaggattcgactgagcacgccatcaggttgacaaattcagctaagtgaatttgccccttagaatggaaatagtggtttgtcacccacggcaaggttttccattcaacaggattgacttattacagtattacagtagctacagtatgtacatacagtatgtacatacagtatgtacatacagcaacaacatacagtagtatcagcgctctgctccatcctgataaagaggatgtattatgagatcataaaataaagcaaacaaccgacagttagtacagtagctgttgttcaatatttttgtatcatcataatactcaattccctatgatggtgttggtagggttgagtgaatacacctgtaagagaggtagaggccttgtactgtaggttgttgtcgcagtatgttgctttcgccagatatgattgtatcattacacagtcattacacacaacaataagtagaccattccctctctgttgcgtactcattgtacttgtatctggtacacacagaaccgtatgtacaatacttgtactgtagtttacaaacccgtcctaatcataaatcattaatatatgcatacaccttctaatatacttgtgcttttgtcttagagaacatcaatggtcttaaggtccttggaaacctcgaaaggagcctcggtcttctctcggatagattcaacggtctcgccctcggcaatctcaatcagagtgagtccaccgttgttggcaatgtcgacatcaaagacagccaaatcagtaatgattcgggatacgcatcgggagccggtcagggggaactggcattccttgagaatcttgggtcggcccttcttgtcaacgtggtccatgacaaccactactcgggtgttgagagggttggctacaagatccatagctccacccatacccttaatcataccgggaagagcccagttcgcaaggtctccgttaccagacacctgcatggcacccagaatggacatatcaatctttccagctcggatcatggcgaaagactcctcggatccgaaaacggaagctcccttatcgagagtgacagtctcctttccggcgttgatgtagtcagggtcttcctttccaggttcggggtaaggaccgagaccaagaataccgttctcggactgcaggatcacgtggatatcgtcagagacatggttgggggcaagggtaggcataccaatacccaagttggcgaacatgccgtccttgaactcctgagcagctcgtcgcacaatcttctctcgtcgcagagcagaggcagacatggaggcggggtcagcagcgccgtcgctggacttcggagaagagttcttgacaatctcaatgtccttcttggcagtcgacttcacaactctgtgcacgtagacaccgggaacatgaacctcctcgggcttgatctctccgggttcgacaatctcctcagcctcggcaatggtgagctttccagctcgtgccatggctccgttaaagttgttagaggtggctcggaacactagattacccagagtgtcggccttccaggccttgatcagagacacgtctccgttaagggcattctccaacacaaactttctgccgttgaactcccgggtctctcggggagtgttagtcttgatcactgcaccgcttccgtcggaggtcttagcgtagagagtggggatcttgccctgctccagccaggtgttggctcctgcaggagtgtacactgctggaatgccggcaccagcagctctgcatctctcggcgatggttccctggggggtcagctccagctcgagctcgccgttgaggtaggcagcctcgaagaacttgttgcctccgacgtaggagccaatgaacttggagatctggccgttctcaagcagcttagacagacccttaccctcaataccacaattgttagaaaccactgtcaggtccttgacgtttcctctcttctgcagagcagaaatgagagtgtcgggaataccgcagattccgaagcctccagagagaaccagatcgccggacttaacgtccttgacggcctcgtcgggagaggcgtagaccttagatctggcggcagcagagtagaaacgagtttgcagaagcgccttggtaatgtgttttcgaacagagaacattggatagttgagttacctccgtgttacgggcaggctagcctttatgtatggttgaggcgggggaagctcggggggttaaaccttcgatagccggggaaaattcggagggggtgtaaacagggcaatatagtcgggttttgaacaccgaaaacggtatcatgtgagagatgatccactgatattacgttcctcccttattaatgtgtgtgccaaaaaatcgttgaactaaagctgactcatcgcttcccgtgtggggttccggggtacaaagttcatctcctacatgcacgcgcatcatgttggtcgggattttgagttggggtaatcagagaccttgccagtgttggagaacattggttggtacgatacgatcaccaggaaagaccagagtagttgtgagcacaatactgatggtatctgctttatcctagttacttttgagactcattcagtgtcgttagtgtctcactaaggtggtctacggtaaccggtggtatgcctgccggagcgtttgtctctctctcatggccaaacatttttagcgtgtttctgtggttgggaaagaggtgaagcaacagtacaagaacaattgtagctacaggtatgtatggccctactgtacatctacttgtagctactgtagatcgaatggccgatcatagttaatggttgcacggttttttttgttacttttgaccaaacatggtgctattggactacgtcttgctgatttgaacaaataaatggcctacagtagtctgcctttcgcagtgtctcgcttaatcaccagtgcagaatatgaaggcgatcagtaagagaaagaaatggcaatgtaatcatctgtagagttgtctgaacaaaggaccgtatatgagctcctacacacagcgacaccgcacgcttctttactccaccgaaaccctgccgtgctagtattcttggtggggcctgtatcgaagcaacagcgatatcggcgacaagggtcggagatgcattatcgttgttatcgagtgtgaaacaatggcgttgcagaaaacatgatgcaggtgttcaatgtctcaaccggtagaataccggtaatacagtatgtacttgtacaaagggtattgatagcacttgtatgtgcttggctcgaccaccaaacgaaccactgcagttcatgtttgctcattcgtgatcatcaattcatcatatatacactatttaatattttccaggtgaatggcgtccagaattttcttggcgccatccttgaccagctgctcggctacgtccttaccaagttgctcggcctcccagttctcctcaaccgctcgaacctgagtgcactcgacaaactcggtaccctcaacagacacgacaatggcgtccaaagtcaacttgccattctcgtactttgtctcaacgccaatgggcacggagcagcctccctccagggttcgcatgacagctcgctcggcaagacagcacagagtggactccttgtcgtagattgcctcgaggatcttcttggtcttctcatcgccctgtcggatctccaggcccaaagctccctggcccacagcgtgcagcatatcgggcttctgcaggtagcctgtgattctgtctccgagatccagccgcttcagaccagcggctgccaggatcagacacttgtagggagtctcaggatcgtccagcttgctgagacgggtgcccacgttacctcgcacactctcgtagacaagtccgggatacgacttcttcagctgggcagatcgtcgaatagaagatgttccaaccactgatccagcaggaagatcggccagagtcttgtagggagagccagcggccataactagagcatctcgagggtcctctcgggtgagaatagctccgagctcacagccgtcgggcaggacggtaggcatgtccttcagggagtggacgataatatcctgttggtcaaagcctggcaccttctctagaagcagagtctccagctccttggtccacagagccttgccgtcgaacgagtacagcggcttgctctggacctggtcacccaaagtagtcagaccgagcacagggaaggagtaatcgggatggaccttcttgagcatagcagccacatgctgggtctggaccagagccagcttgctctttcggccacccacaaagaccttgggcagttcgctctggtcgtcaaaaatcactggtcgttcctctactgacattgttgcagttgtgccgttatcagaacctgaataatgagaatgctctataactttcacctgcaaagtttatgtttcggtacaatacgtcctgtgcgatacaacccaagatcgaccgactgcaagtcttgtatgttgagaggagttgggaaggggttttatgcgtatgaagggtggatctatctactaatagaagtatttatgtatgtggtgcttgtgcgctgttaacacttcaactgtagacctcgctatgtccgtaaatttcatccctgaaaaatatttgcataacaaggagttgaacccagagtctagaacaagtcctgtatgtacatgcagtcagagcaattagtaagagattagtgtgcttagtaattatgagagcgctgaagtgagctctcgtcatatattcctattgtcaccccaatgcccatgatgacttcccaacatatagaagccttcgtcttatatgcctctcctgtcttaagtcattcttttttcgagctgcacgacatcaaccctaaatgacgaacatcaccactaaacatttctcagatcaacccaaggcagacacacagcatggagtggaccaagtgttacgcgaagctatcggccaatccggacgactttgagcagtggaagaacctgctggctgcatcgcattcgcttggaggaggtcttaacaagggaacagcagaaagtgatgtgcaattgtttcgattttcttacgacaactttttggaacggttcccgctggcatttggatattggatcaagtatgcggagacagaattcatgcttggaaacactgagggcgcggaaaccgtgtttgagcgaggaataggaaccaaccaagtttcagtggagctctgggcagcctatgcccggttcaaaatccgagtctgtcacaatgtggacaagatgagagcatttctggagcgagcggtgagtcacgtgggcaaccacttctacgcgcactccatttgggacgtgtacgtggaatttgagagacgcgaggcagagattgcaacggaaaacaagctggctcgactggccgagctgctgtctcgaatcattcgaatccccatgcatcagtacgcaaagtactttgacttgctgcgcgacatttcgcggcaactcaaacccgacgagctgggctggattaagaaggggaaggacaagagcaccaacaacatttacgtcagcacccaggcagagaccgcccgaagatgggcatacgaacaggcgttcccacggcagtattttcatgtgctgttcgtcaaggaggaggatctgcaggcatggagacgatatctcgatttcgaggagtctgagggcaatctggaccgagtgagaatgctgtacgagcgagccatcatcgccacttctcacaacgaggaaatatggttgcggtacattcggttcatgcagactgtttcttcatctctgcgagtccatcgagaggaagtcagcactctgtttagacgagcatgtgcactgcttcccattggacgcctggaggtgcgacatctctatgctattcattgtgagtctcttggagaactggcacttgctcacgacatctacatgtctattctcggggcattccccaactccatacagaccattctgctctttgtcaactttgagagacgatacgcatactcgcagtttctagcgcagggcaagtcggtcaagaagcaggcagctgtccaccaggctgtgcagctgttgatgcagtatctggacgacgaaaacagtctgcgcaacgtcgaaaagtgcgagattcttcagctattggttgactacttgcaggtattccctggccaggctcccgctaacgtaagagacatcctgtcgaggtacgagccggcgctgaaggaggaatacaggttttggaaactggccatggattacgaagtcgaacgagtgcataagcccgtgaaggatgtgtctgccatgtctttccaggatacattgacagagctcgctgctgaggacgaatcgcaggctctggctgacgagaagacgaagcgtctgtcagatattgtcgacaaggctctcgggtctctattgcgtctggaagacaagcgggcgcttctgaaacggttccttgcgtactgcatcgaccaagcctccaatgtcaaggactatgagaagtactcggcagttttgtataatcttggaggtgttcaaacgacaccgcctgccgagcctctcgacaagccaggagatgctgctgttagcgctggtgcgggtaccagtactactacaccagtggccgcagagtcctaaaaatgtaacttgtaagcataatcataatttatctgtttgaacgagcacaactgtaaggacacaaatactagtcatagactgagtttgcaattcatccgatcctcaatacaataacttatctatcatgtctatatactggtttagggggccagtccagcggcactggcaaggaacagaccaccaacagcgaacgcaaaggtggccagagcagcggttccaacggggaaaacaatggtggctcctgcagacttaattcgcttgtcagaaatgatgaaagctccggttaggaagaatcctgtgttagaggtatgtttctgtaatcgaatgttgttatgtctttggatatccaagtgctgactgtaattgagggttggaatgttcaaattgatgtcgatgtctttggttgtgtgcacaaatgggattgtcttgtcaccatatccgcttccatccagaccacttcttatctgtgccgtgtgtcgtgagttgtgtcaccttccacatgctgatctactcaccaataacaatagacaccaatgccacaaggctgtgaagcttgacatcggggtaggagctggtccagggttgtcctgactcaaaagcgagctttgtgttagtaagtgtagtcttcctgggcgctggctggtactcactctgatagcctcgaaatccgacatgatgatgacgacgtgtaactgctgcagtgtacgttaagatgtagcggagtctaaatgcgtgggagcacaaccttaaagagaaatatcgaaaatactgcatgaaataaatttaaggtgagatttttctatttactcactactcacagcaaaagaccttacaaaatgcgacaaaagagagcgaaaaactacaagaagcagatgcagagctaccatctgaacttcaagttccgagagccctaccaggttctggtggaccacgacctcatcattgaatgtgtcgagcacaagtacgatttgctgaagggtctccaaagaacgcttcagaccaaggaggtcaagcccatgataacgcaacacagtctgaacaagctgtttgagagcaacaacgaggaggccattcagctaggcaagacctttgagcgtcgacgaaccctgcatttcgaaaatagcactgagacccaggagaaaaagctgaagtacaatggttccaacgctgcccggaagatgcatcccagcgaggccatttacaaatcggttgttgtcgacggctccaatgtccacagatacgttgttgctacacaagatcctagtttgcgaggtcgacttcggtccattcctggagtccctctcattcatatgaaccgagccatcatgctgctggagcccttttcccctgcttctgagcgtgctcgtcagctgattgaggcgtccaagctcacatccggtctcaatgccgtaaagcgaaaggcacctgagggagatgaagagcaggccaagaagcgaaagggtccaaaggcgcctaaccctctgtcagtcaagaagaagaaggtatctaaggaggatcagggtaagcgagagcgacctgaggagaaggaagatgattcccagtcagtcaaaaaggtgcgacgaaagcgtgccaagagaaaagatggtgaggggggagaatccaatgagggtggagagactgatgaagttcctcaacttgtgaaggattcccccagaactggagaggataatgagactaaagaggagactcccaagaaggaaacgaattcggaaggcaaggacgatgttcctatgagcgacgaataagcaaataatttatacattgatagatttacagtaggtgaagggccgaacaggctacggaggaggtagagtagacaacaatgtacagtggtaggagaatattatagtatgtgtcgaactgggaaatgataataaacaacgcgagcgtatatctatctgagaatcccacagctttactcactctcactaccgccaacattacacctcctcaattaccctaaccctacccaatacttcgcagatctccacgagatcaactcgacaccaggacacaatgctcagacaatcacggcgtcttttctgcacgtctcagcgggtgctcaagaagcgagagtcgccccttcagactgcctttggcaacgatgacccctacgatgacggttttttccacattggcggcaacaactacaaggtcaagaaccccatcaagccctccactttgaacattcccaaacgatggcccaagatggccaccgacgagcagcaggatgtcgtcgattacctggaggatcagatgcgtggagactggaagattatgactcctgaggagaagcaagctggtgagtatggaaggggagaacagacactaagggtatgagtataggagtgagatactaggagacacaaacccggagcgggccccaaccgttaccccggttgattattccacaaacgagcccataaactaacccagcttactacatctactttggaccctggggaccgcgagagcctaaccaggatcctgatcggggcatgcgattgcttacccgatccatcttgtggatggctgtcggattcgcattctacactgccgccaaccagtacattgagttctccgaggagagcgactctgcctccaaaaaatagtctgtatatagccgaagtcttgttttcgtttttagcttgttgcccgaactgctgttgcactagtacatatcgaagacttcttggtcacgtgacacgttgcacagcccgcaaaaaatcgccaccgtaacatactgggtatggtggctcctgccctattgcatataaggcatccgtgattccggcttttacgccacccacatttgtcatcctctctgcaaccctaactccgttatataaaagtggttgtcttcttcccaacatgcaaagtctggatagccagactggcgcgcgccatacaactcattacatcaccacctgaaacaaccaaacaacaacacacgtcaccccacgccgcacacggttaagtaacgacaggtaaccgaagaaagaaaataaaaaccaagccacagccatgtccactacagctcgaagacgtctcatgcgagacttcaagcgcatgcaacaggatcctccccagggagtcagtgcatctcctgtggctgataacgtgctgacatggaacgccgtgatcatcggaccggcggagaccccgtttgaagatggcactttccgcatggtgctgcagtttgacgagcagtaccccaacaaaccgccagccgtcaagtttgtttcgcagatgttccaccccaacgtctactcatctggcgagctatgtctggacattctgcaaaaccgatggtcgcccacctatgacgtggcagcgattctgacctcggtgcagtcgctgctgaacgaccccaatacgtccagtcctgccaacgtggaggcgtctatgctgtacaaggatcaccgtcagcagtacgaaaaacgggtgcgggacacagtggaggccagctggaccgactagagcggataagagacgaactagagataccattttactgggaacgagggaggggcccgttagcgggacacgcatcggttgcattaagaggaggaaaagatgaggaagagattagggcgtctgccaccatcatgcagtttgagccactagacaatggacgttgatggggatgtttggttctagaccagttcatatatctaatcaaaccttccggaataggctgtaagaagagtaccgtgcttacgtgaaccacctggatcaggagatattctaagtcgctgtttttcgtttgaccggtgtagtaaatccgacatgtcattaacgtcagtaattccgctgaatacgaagcttatcaaactaccagtaccgtacaagtacatactcatcgctacttcacctcatacatctgacttatagcccgtcggagatgctaaatggattaaactacttgtacaatgaaagggggccgcgtgtggctatattgaaagcggtattttggtcaacatggttccgcagttcctgcgcatgttctatcctttggaaaactgaatggggtacgagggatatatatttttacctcagttaaacatctgttagctgcaagtacaatagctactggtaactgtagttggatgcttgtctcactgtgtacttccaaggttcgctgttagtcaacaaattgtcttcagccacatcttttattgctgtcagaaatagcaatgctacggtattttcggtcagttctttttctggttttttaattactatcattatctacattctagtgaagagcgctctttcgctcgagcttctcgggaagctcaaccatacccttggcctccttgagctggaactggagacacttgagtagctcgtaaaccaccgacagaatgggagttggaacattgtactttttggccacatccaggggtgccttgagaatcacctccatttccatcaggttgcccttctcgacatcaaccagcatggagggcttatagtagacctctccgtcagaatcaatcatgtagtcctcgtcctcctcggtcagaatgtgtccatctgccttggcaatagctcgaatctcgcccattgcaggtctgataagagaatcagacactccattgagccacagtcgacctgagtccattcgtgtaatggaacagatggtgttgaaggtagcgttgtacagcagctttcgccatcggtggtagaccacatcgtcgacgtagtgagcaaacttgggtccataagcctggacaaattccttggctcgcttctcctggggggccttgtccgatccgttgtcaaagtatccaatcttgacgtagtcaggctctgcctggtggatctcgccggctccaaggttggtagaaccaatcatggacacaccagagacacagacattgttagggaaggccttaacgatgggctcctcgatgttgaggccgttctggaacaagacaatggccacgttgggagaagactcgacaacgggtctgatgatgtcggcagtagaaaagacatcgggcagagccttcatggctaccagcacgtaatcatagttcttgtcattagcgattgcctcctgtacagagttgaccattcggtggggcttccagttcgtctggtcgccgtggtcacaactctcaatgttgtatcccgtcttcttcagttcctcaaagttggatcgcaccacaaaagtgacctcattgccatgctgggtaagagagaggcctgcaatagtgccgactcctccagttccgatgatgagaatctttgccatcgttttaatatgatgttgacgttggttatgctcttgtatacactgaaatgtggggagacatctcggctactgacaaactctatgcgtctccatgcaccgataccggccttgttcgagggcaatattagccgctgaagaaaaaatggtacggatatcagtaatggtatccacgtcgtacgtaccttgcaaaaagagataattgacgctttgcttgaaggagagaaaaaaaaattacagcacccaggattctcgtatggtctcccactacaatactaactaggctctctggtgcttgactatggctgatcggacgggaagccgtattttcaccaggatatggccgtaaccaaactgcgccgacccggaatcgaaccgggggcccatcgatggcaacgatggattttaccactaaaccatcggcgcactgattgttgaagaaattctgccacttgcgacaagttcttaaaaatgattttttaaaaaaagtgtatgatttattgaacgcctataacccggcttactacaagtaggtaatctgctgtaatgaatcattagcataaaaaaatcaaaaacgaaaaaatacggggaaatacggggggaaaacttagagaaatatagattgaattattatttttttcgtgttcagtattagccctttcaccagtacagtagttactactgtaatgctattccctctgttatcgttgcttctacttgtatatagagattcgtgtaattgtacactagtaattacagtaattttgccaccgcaaatgttccccattggtttaataacgttggcggacattcatccattcataacaattcatttcgttagggctctaactacagtaaatacacagtatgtactgtacatactgtacttgtacgttgcactgttttttaagctacacattcttgattcctggcttgacacccggcggcttgtgattaccatattagtaccttaaccttcccacaaatcttctcttcttctgtgtcacacccttgtcccttgctcaagtccacatctgtgggcaagttgcaacatgggcaaaaccatccgctaccaacctcctcgaggagatgatacccctcggtaagatacccgtcacttgattctgataccctgaaccctctctctaacgcagacctttcatctcacgctacaagaagcagtttacgattcctgtcattccccctacgcagagtctccccgccactcgctcagctcgtctcctcagtgggcgtgtcagaaagtatttcgccagtcggaaacgtgtcgactttgacgtggacgacctcgtcacttacacaaacaccatctcactcaattcctcaactggttcctatgataaccacaaatttgaaaactgggacgaggtcgatctacctatcatgaaaaagctcgccagacggagcacacgtctggagagagcaatgaaagaactaggagacaactacctcgttggtgttgcttctggaaggagcatggattccggccgacaggctaccgaagaaaccgacgttgacaaggcttcgacaatttccaccacagactcctccggtgccagtggagcgcagacttttgttgacttcgatgaagctatggctagtagcggctttgtcagcatctattcagacgaatatcctgtagtgtctgtcagaccttctgagaatgatgcagacatcgttttcgagtcagaagtttcacaacctctcagtggctctgagagtgaatctggccgtgttgagtatcagagcgaatccgaggatgttgcctcctcgtctgcatatgagaccagctcaagtcgacctgagacgcgtgactcggtggttgtcctgaccagctccccgagggtcaacaccgctgactatcctgagtctgttgcttctatgggctctccctccgagtccattagcggttacgaccgagactccctgccctcctactcagcggctgttgttggcggctaccatatggaatctgagccggggactttcccgtgtcctcccgttgacactagctcccgggagctacgcgaagatccacattccgccgaggcagacctggattttgcgcttgatcgcttcaatctcgaagaggacgcagagttggatgtggagagccgctccttggctgcgtcttcatctcagggtacttcgactacttcgtctaccttctcggactccacctgtagctcttctgaatgctatgtgtcggacagtgacgacagcggtgactccgatgaggatgaaggcagatctcattctgatagcaccgatggtgatggaaaccagaatagagaagacagcaattctgacgcttcccaagggtctcgctacggtttcgaagacagtgttgacggcaataccactgaggaatatgacagtgatgacagttccaatgaatctgaaagcgacgacctgatccttttgttcactattgcgaatttggatccagaggatctgattcctatgagtgatgggtctggttacagcagctctggtagttcttacgacaactgctacgcatatcagtctgatgttcagaaggtcgcgggtcttgcttccggaccccccagctccagctacgactactacgaccaaatgtctttcatttcctcagaggttccccgtagcctcgacaccaagatgagggaagagctggggattactgtaggtcagattgatgtcgtcgaccataacaattcctcggaagaacgacttgactcttccttgtcccagttcaatgagactggaagccgcgggagtattctgggaaacctccatctgggacgagatttgtggtcagagctttctcggtctccaccccctccgaagtctccaaccccttatcctatggagtctctgtcgcctgttcttgttcaaaagaaattcaaatgggatgtgccccctgctgccccattccccaagcctcgcatgacttttgaggaaactagtccaaaggcgtgcgtggagcccgagaggtttttcgatgttccccaatccatggatgtgttcccccctcttccttttccccctgccccagctcttagcgtgactgtcactgaagcctctgaagttcagtcacatgactacttcccctccactgttgtgagctgtgaagatgcgcgacttgaagataccttgaaccttggtgcccactcctttcgtcgtcgagtgtcaagacggatctctttcacgcacacacgactccgactggatatttggaacagcatggctgatatcctttgtggtcatggtctccctggtggcgcttttccagagaggaaagatattgaacagatggagaggcagagtacctctgcgtttctttctgaccctatggacagtgatcatcttggactctccacttcatctgcagaggtggatgagcttgatttggaagctagcgatcttgacgatgacctaatgcttcgactcagacgatacagcatggtcgacaccggtaccaagattgagcatatcgacgaaatttttgtgagtcctcattcgcagtacgccccagccagctcatctttctgttccacatctgactataactcgtctgggctcaccccaacaccagacacatcgccacaggatttcctccccactgatgatgttatagggaaggctcctctcgcgtgcaaaactgtggtaatgtcctcagagggctcttccgacttacctacttccgaatcttctcttggagacctggccgctttccccgaagcaagccctaattccctggggtcatgctcggtagtggtagttaagggagacgttggctcagcctcctcctcgttggttatttcgaagccttctccaactgctgaatctattgggcaaagatcgtcgtattcagaccgtctagaggctggagcgcgaagtgaacaaacatccggcgatttttcttcaaacctaccgagcaccgcagatatctctgcttccttgagctcatcaactcgagccaatgacaccagagatacatcttcttcaggaccctacacttcatctgctgatgtgtctggctcgccaacacccagctcgtctaggcatctgagctcttcgaatgccaactcaggcagcaatgattccaagtcaacctgcagccctctgattctgtttgacccttcctcgacatgtagaagcacaccttctctaccaagacttcgaagaatctgtctttattcccccgctatggtctcgtccgagtcagaggccgacgagataaaacacgagctgttggatgctgtctctgacgcggcatctgtaattactgggacagcaactgtgaatgttctttcggacgtgagtggcacagccaaggagagaccaactgccattccgtcggtgccgcctgctcctttcccctcccatcgtgtggcctctccgggcattgtttctattgtgccttaccagcctcctaatgttccatttttaccttcaacagagggtcgcaaggatattgcagccatgaccaccaacctgcagtccgagctgtcgagctatttcgatacccccaaaaagtataagggtaagatggttctcggtgatgtgtcagctggtgttttgggccagtcaactcctacatcttctaacatcacggacgagaaccttatggatgttcccggatcttgtagtgtctgcgttgtgggctctccccatcccaactctggttcggcttctacgcgaagttccagaaaacgaagaagggagaagtccgatggggaaagttctccaagattacttgtctccctgaaagagaaggtgaagcgctccttcaagtctgagtccaagttacgaaaaagcgagctggaggatcttgctgctgcggccgccggattcgcctacaaaagcccaacttggaagagtccttcatggaaaagtcccactttcaagagcccctcttggaagagtccatctcattataacaacaatgatacaatgaagcggcatactatcagcaaattcttcagccggtcccgtgacgccaccctgcgtgactgaagatgtctcaaagtctctggtaatgtctcaaccgttgtgccgatcatctgtcttacctaaaatgtatgtaatttatgagtatgtttcccctatgagtgagtaaggtaactgaaataatctctattcttctataatatataatcaggaaggggggttaccgccgttggtgcttccgttggttccatcgccgttgatacctccattggtgccgttgataatgccgttggtggtaccgttggtggtgccgttggtggtgccgttgatggtgccgttggtgttcttaacaggctcgggaaggaagaggtcgggccagaccttgggaaggtcttcaatatgggagatctccacgacacctggtgttcctgcagggatctcaggagctccagggtaatgcagatacgcgttctctgcccatccgaacttcttcgaagccttgatattcagggcactgtcatccacgaaccagcatttgctcttgtctgtgacacctgcctgtttcatagccttctcaaaagcctcgggctttggcttgcagtgaagtggagtgtggtaatagtcgcagtatgtgagcccgtcgatgagatcatccacgccaaccagcttggctactcgctctccgtgggtcttgtaggcgttggtaaacagccagagcttagagaccttggttctgtccagacgttggaacatttgtctgagaggctcatctctcttgaggatcttatctagaggcaaagagtcatccacgagccggttgtattcgtcaatatcaatattgtggtgtctcagcagaccgtccagagcgattccgtactctttgtagtatcgatggtgaagctctgtggcatgttccttgtccagaccgagtttggtttggaagtagttgttaattcgctcgcccatgagagcgtccacgcccttatccttgctgtagagcgtgttgtcaatgtcgacgaagaggacaatgccctcagccttaggagtgtcttgagtcattgtctttagtggtcttgtgaggatgcgcgttagagaagttgtacgcgcgaaacggggaaaggcaagtatcctggcaggtgctcaacacgggatcgttcgggtgaaagggaacggtctaagagtgttgggttgagctgaagagatggactggatcgtttctgcacgtgcaacctaagcgagctttggattaggggctggcaggtggacagggtttaaaccagtgggttagcgagattttgactgagcttggtgagtaggactcaaaggtgtttttgcgacgtcacgaacgtgagtttgatcggtagcaactctcgcggctcacgtgggtcttggccggttaaacactgggtcggatcaaggcgagggacttatttgtataaaccataaagcgttgaagaattgtggtcatggcaccgaaataacgcataggtgatgcgtgacggtacaagtgcttgtatgcgaaaagtgggacggagtaacattgaactgcggagcggaaggaaacaacgcccattggtaatgaggaagctgcaattgcccgaattgccctgtaaaaacacggggcagaaacgcagaaaaagttgtgagaaaagaagacaagactagacgacttggtacagtactgttcagtgcgaggctgaatagaaaaatagtggatagacgtatttctgaaccgtctcaacgcatttatgatgacgtaaccaatgggcgtgaccggctccgatatcggtgtgtcgagtgctgtgtgtgtgtatggattgtctgtgtcgtggtgctcatctttattgaatgctgtgctggagtgttgggattctcgggttctgaagtttgcttttgacgcatacagcagctggtctctatatatgtgtccgaaatgtgctctcagtcgaccccagattgtggactgataatggactgatttatgtacgtctgtgcatcgtttgcatagtcctggagtcaaatgtaatgtgaaaatgtgggtgtgcgacgatgtattgatgatatctgacgtgtattcgaacttacaatacaagtagagtcctgactactactaccccttccttcattattacgatgacgtatttgtcacgatatttttttgactgctcatattacgctacaagcatgagtagctacaggtggttactgtagtggagtcaaggctgagatctacagtatctgctgtaagcaaatactgcatccacccttggactaaaatacaggtacttagacttgcacatactgaaatttacgctgcaacattcaactgtactgcgcatggattgggattaaatgcagcatccgaactgggcgaaaatactactggacagaccaccgactaatctccatgtgttctccccacgtccagatccccacatgcccatccgccttgttcgcatgcgtttcagcctttgttcgaggagtcccacaaacaaactctgacagtaaagttcgggcatgccaatgactctaagactctatctatcgctatcaagactttaaccatgctccactgcacacgacaccacagcaaagccatgttgcggataaaacatcgtccggcacacttgctacagcggacacgtggatcgcgctacaattcccagcttgcatcgctctcgttcgagcccgaaaccgtgcgccatgactaccccttcacgtcagcctaccctgtgggatccaaggtcatcaacgaacagcacttttaccaaaatgacattctcttcaactggtacaacaaatcgccgcatcccgtgtcgcttcgacagctggccttctttggtcgaaagttgacggaagagaagatgattggaagtgccaactttgtgcgaaccgagctgcccacccgtctggcccaccgaatcagagacttgcagtgtctgcctttcagtgtcatgcgcaacgaacacatgtcccaggtttacgagctgtactaccaagcattcaaccagtttcgaaagttccccgctatcaagactttggaagataatgacaagttttgcaagctcgtctctgatctgctactcgatcatctgaccatcattccgtcgctggtcactggcggtatcgaatgtgcaatggaccagctgatcgaacccaagagacttgacgacgtgatgagtctcatgcttaggtcgagaatctccagaagggtcattgccgagcagcacatttcgctttcccaatccttcaacgagtcgctggcacagggaaagcgtgagacggcagagaaagcaagcgactacattggggaggtcttcctccagtgctctgccaaggattgcattcgcaccgcttctgcgcaggcagaaaccttcgcagttcaggtcatctccaaggagctgtacatgtcgccagcagatatcgtggtacccgaagtggtggttcaaggggaagatgccaagttcccttacatggactcccatctcaagtatattatgggtgagattctgcgaaatgcatactacgcaaccatccgacgacatattgtaagtggaaagggaggaacgccaccaccgatcctcgtgtccatctccaacacaccctctgatgtgcgaatccggttctcagaccagggaggaggtgtccccaaggaggttcagccccacatctggtctttcgccaaaggccctgaagctacctctcgtctggacatgtttaagcgaatccccaagctcgctggcgtgccccacgaagtagactttgctggaaatctcgacaccaaacgagttatttccacagatacacatgaatcctctctagcacgcttctcaaaccgacctcctaatgtcaagcttggaatcggtctgcccatgtccaaggtctacgtggaatactgggatggtagcctggacctcacatctctggaagggcatggaacggacgtttctctgcgaatctctcgtctcggtaatcagaacgagaagttgcaactcgacagagtctaagaagactccacatttgattgcgtgtaccgtcatgcattgagggacggccgcctaacatgtaagatatctcataacaatttcataattactgtcatgtttactctacagcacgtaattgtatgtaccgctgtactcattgaaactctcgggttcagtttgctaacaggtatggtatggtacaatatgttcaggaaataacgagcaatgattgtaggagcaaacactgagcgagcaatacgtgagtacgatcaagtactacttgtactacaagtagtgttgtagctagcgtacagtgtacagtacagtacttgtcaaacgaattattaattgtagtgtaaaaaatgcaaaaaagtgttgactaacagaggaattaaacctccttgatttccttattgaggccatcgtcagtcccgaagaacaatgacatggacaggaattgaacctgcaacccttcgattacaacttcaagctggagtcgaaagctctaccattgagccaccacatcaacacgcttaattttttgttagggatcagcggctaagaaatagccgcctgattagtctctcgtgaaccgctagcggagactacgacgaggggccaccacgtgggccctcagtgggattacgctatcattaatatcgatatgccaagcctgctatcacggacaaagggttgcgccgcaaccctggataacatataaacccctgtattccatgtattctaatacacctttcttgagagtgacggcagtgaccataccttcggtatggccaccccggctgagtcatcagtcggcttagtcacggggcctgggttctaacatttttataacgattcagaagctagtcataaggtgttatcattagtcatgtaggcttactaggtatatagctgtaatgaatcattagaataaaaaaataaaaaagaagtatatgagcctcatagtgtggtagatgtaaacaccaactacattctgactatggttactgtgtatcttctttgttatactactcagttttggtctccgtgactctgtcatttgacaacctatagggttcacgacaacggcatgaacgataccacgcaaattgtcccccgttgcagccttgacaactgaagttcattagactgcccattggagtcttctcgatatccgaagtagttgctttctctgcttatgtgagttcctctcttctcaatgtctgatttttttgcgcttgtgatatgatctgacctgatctataaccggcagtacttatacagatactgtaaatcggcgtactctccaccatcgttcagccgtgttagttctatctgggctataataattttaccattccccgtagtctcattggctacctctgataacccctacgacagattactgtagcgacagaatgtcagaatgtgcatccaaggttttaaaaggacacagaacgttttggtgtgatggaagcagtcagggatcagtggtcacgccaaagcgtagcaattacttttatcataataattgacgctaccatccactatcagaatcatggaagccgctaagtaactactgtatactattcggtcggtgtcactcttagagtgagttccacacgaagcaatttaacgtatgattgtacattgtacttgtactcacaaaaaccgcaagcggggattacatgccttcgaaactagcaacataacctgtatctaaggagcacaattccaacgaacagccagccttaaaattaatttatgcagactatgcgatcgagaaaattccaccttcagctgaatcagactggtcagttgttgctgccctcgcaactcaggtttacacatggtttacacatggtctccaaccttaaccttagagggcatgcgcatatgtgcgcacatcaagttcatggattgaagtgcagtataaatcccacacagctttgtgttccttctctcaccacactatgtcactagacacccccgattcgcttgcgcgggatttctccgccaagctgttcacatctgagaagcagctcgagcccatgtctgacgcagtgcttccgccgagttactcagccgccaccagcgaggctgacatgtctgatgtcagcacttacagcgagtgcaaggccaccacgattcccgctcccgaggaggaaaacaaggggatgacagacgtccctgtgcagatatctactctgccggaccagcggtatgatgatatggatgtttgtactgcaatgaatctactaaccacagaagagacatcgtcgcaaagaagggagccgtattcaacctcatggttgtgggagaaagcggaacaggcaaaaccaccttcctcaataccctcttcgctgatgaactactcaaacgagtgggatctcgacggagaccgttcccctttggcgggcaggaggaggagtcggcttatgaatacactggcgacgagtcggcgaattcacaacaccatcgcacgacgaagattgagtcggcgacctttgatctcgaagaagaaggcgttacggttcggttcacggtcattgacacgccgggatttggcaattatgtcaacaacacgaactcgtgggtccccatcgttgagtacctcgatgaccagcatcggcagtacctcgtacaggaggagcagcccgagagatccagaatcagggacgtccgagtccacgtttgcgtctacttcctcaagccagggtaccgactcatgcctctcgatatcagagccatgaaggagctctccaagcgggtcaacttgatccctgtcgtgtccaaggccgacacttttaccatccctgagatggaggctttcaaggccaacgtaagtgctatcgtttgattgtgtgctgatttcctttatctaacattctaggttagagctgctatcgacgctcacaagatccagatctacactcccagtgatgactacaatcttggctccctctacacctctgaggtgcctctttccattatcggctgtcacgattctgtcatgggacgtgatggacagcagacccggggccgtcaatatgcctggggcgttgccgaggtggacaaccctgaccattgcgacttcgtccggctgcgggagattatgatgagccactgtatgctggatcttatcgacactaccgtcgagcagcattacgctagctacagaatgcagaagattgagcttgcacgaagcgccatgaaggatgctggtgcctcggaggaggatattactgctcaacccttctgtatgcttcttcgaaagtctgccgcccagctccaggagcacgacatctccaacagcatcaagttccaggccaaggtggtggagcttaacaggcgattcgccaagattgtggagaagcaggaggagaatttcagcaactgggagactgagctcacacagaagcaggatgaattcaacgccgacattaaaaagatccatcgagagtgagtatggtggagggtgatcttttgaagagttactaacccagtgtgattgatctagaggctgcagtcgatatcctctcttaccgcgtccggaatgatcccaaggatactggaggacgcatttccaagggcaaggccaacgttgctgacatcttccatcgagatcgctagctgcactcgatagagttcagtctgtttacatcctgaaccctacttgagctatcttgcattatcgctgtatggctacgtggagtcaatgaagtaccggttgattgggttcctgctgacacaggagtgatccagatgactctgtgagtaggcttgacttgcagggttgtattgctgttcgtcctttgcagtaggcaagttgactgtggaaagagcggcacatattaatattatttatgagtaaatgtttattttgtagtttatcgattggtgtacagcaattaaggaggagtatgaagtgcaaataatgtcatggatatttcccatgggcataatagtgttgttatatctttcatagtgtttattcctagacttctagactgtgctttgtcccatatttctgactcagtttggcatatggtgctcattgaaggtgtattacaaaatttcaggaacgccccacatgacaacaaaagtcctcaaaaacgagaacaagattcaatctaaaggtccaaacaataatacctcgtcaggattgttacagtgtgaaaaaaaatctcatcattccgagtcttcaggagctgttttcttgcttgctacccctacatcacgtaaccaatttttcattgagtttcaaattggatgttggacctgcgggccgagtttaatatacctgtgggtgtcatccgaccggaatgagagccataaagacgcggtagaaaagagaaaaatgacgatattaaattaatattataataagtcaacatttcttcatgatattttttttataaaaacacgacaatatccacgttatgactcgtctgacggtagactacaatccagtcacgctccctggttgcaactttgttggcgtggaaccctattgtgtggacgcggcatgaaccactcatcgaagttaggattttggttagcagaatattacttgtcttcacaacagagcagagactcaggacggtactttgaaggtggaaagcggacgtttttttgaaaccagcgagggcccaacaacaacctacacagaaaacatcccagctccgttcaaagtacacttaatcactcacattccacactttccaatgatcggattggactcgcccgtactcaaacctctggatgccaaccagagcaaccggtctcccaagtctggcgcgtcttctcccaccaagtcgtcgcgaccttcctcggctcgatcgggctccgtttcgcctctcagaagaggccctctgagaccgtcttctcctatcagacgcgctattcaggttcaaagagatgcgccagcgttcacaatctacgccgctagcgaggaggaggagacgcaaacactcaaaacttgccaactgatgccgaaggcagacatgtttgacgacgaagtacccaaggaaaacatggtggaaggtgtcgtgcaggccgagggaaaggacaaggatgacagcgagaaggctgcacctaaaaaatccccttcaagactcggacgaatgcctctgggagagcactggcccaccctgagaactagcaaagtcaccaaacctgtcacttcgcccaagagaaagcccttcactcctctgtctgcccttgacttcccagcatacatttctgcgggcaacaacgaaaacgtgttgctcacatctgctaagggactcgcagttttcgacgagacattcacatacgaacttccggtctttgccactccaccaagaaagcgaagaatgtccattcctgctgctgacactcgtaccagcatctctcaaccgctggtccaaacctggcaaaaaaccgcattccccgttttccaggacgagtgagatgccaacaactaactgtaagataagtaatatatgtactatagcatgactaacgaatgtgaggtgcgtttctgtgacgatataccggcatcttacaactcagataagctcaaggacagtgttccagtatgttaatattatataactatttaaccaactagttctggttggagatgagaggagctcgctcattctcggcgtcgacctggtcaacggcgggcttcttgaagataagaccaacagctgtgagcacggtgagcacaaaggtgatggcggcagcggcgaaagcaaagccccactgcagagcaatgaccttgtagaagagctggtgcacaccaataccccaggtgaggaactggacggcaaagccaaaagcccaatctcggtagaagaagagaatgagcacggggacaataaggaagtcccagatgagcacgttggcaatgattcgagctaacaggccgttggcgtggaaagcagcagctccagtccagaagatgttgtagaaagtccaggccaagggcagggcagacacggggacgtgaataaagatgaagttggaggcaggtcgcagggagtaggtcttgtgcgagatgtaaagagccaggacgttaaagaaattggcagcggttacaacaagagcaagaacaaggtggccacgggcaaagagccaggcccacaggaagtgaagaatgttgaagacagagaagtggtaggtaatggagccagagatggcagcgggctcggcggaaaagacctggctgaggtacagcagctggaaaccaaaggtcaggatccagaaaatgaagataaagatggagcttgccgagaaagcattggtgtggatccaatcgggaccatcatggtcagagtgggatgtggcgataccatattggatgttggcgtaggtggccagagcgaaaaagacgacggtggagagcttcttgctcagcagcgaattgggggtttcggcttgagtgacgggcattgtgagagacgggagtgcaaccaaagagctaggaggcaagatacatacagaccagacgggctcttatgtacgccaccatttcttgaaagttacggttctacgctaccgaaggtccgtattgtggagtagcaacctgtagacgagtggaaaataaaaccgcaattgtggggaagggagatgaaaaatgaacatactccatgattttgaacactttaaagacccaccacagcctccaattccgttttctaccccagcttcgcggaggtgcaaaccccagaatcgtcgtatagagttagcaaccttcagacaaacggaggcttatggcttgtagagtttacctaaaggcacatcttgccttcctcgaatcatcgactgtaacctgtgagtgtgacagggaaacattaaaagaggtcgtgtgaccaattttgcctcggaagtaataattgggctatgccatcccatatgaactgcagcaatcaatagatacaagaactataggtgctatgcacaaagagctataagggttccactagtcgaacacaattcggaaaacaagtacaagtacacctttttcttcaatacacatgcaccgcagcacatacttagatatactacagcagattcgcacactgccgtacagccagtactcacagattgcgccatctgcggcgctggtttggctcaacgcataagcctgcatagtcatggccgtcaatcgagttgattttgtttgttggagctgatgaactcaatgaagacgcaagatgcaagacacaatgctatggtcgtgccatagacataatggatggctcaacaatgaactgggtgcagccttcacgacgaccagagtcggtttaaaccaaggggcggcagataaaattaaggttttaggtttattgtcacgtgacaaatccacaaggaaattagaatttattgattaaagctcctgcaaaaaaacaagcgccgatggtttagtggtaaaatccatcgttgccatcgatgggcccccggttcgattccgggtcggcgcagtttggttacggccatatcctggtgaaaatacggcttcccgtccgatcagccatagtcaagcaccagagagcctagttagtattgtagtgggagaccatacgagaatcctgggtgctgtaatcttttcttttggaaagtattacgcaggcgatgatgagttaataaaaaattcgattagtcttgaagacacctaagtggttagaacatttatgaaactgagtcctctctttttggccttcagtatgtacagaatgaatgcttatctatattagttaccgcctcgtgttgtattcacctaactctagccttgggcctgtttcttttcatcacagtcttgggtcttcctcctaccctgcgagcatgttgtttcacaaccatacgtttacgaagttggtactgaacaggaacaacaacactgcctatagtagcggcgttcttgacaacacctgtggtggtacccatgagagcttcgttcgtcttcaacacctgtttgatgttccccttgactaacttcttggacttggcacgggagtacttgtgcgagtttgctaatgatgtcttggtcattcttgaccgatgcagtttgattatcattttgttgaaaggtttccttttggctctcttaattttctgcgaagcgtgctccttcttgtagtgcatcttatggttcttccacagcgtcagaatggctgcgaaggcagtacaaacgaccagttgggggtcaatcttcttctgatcgaagcttagacggaattttgtgtagtcgagacgctctacctttgcaattcgttctcttgtcaacatttgctgtccatcaattcggtgatgtcgttcaagatactgggactcctttccccagacgtagagagataccaggtccatatacttgaaggacaacgacggataaggccaggtattggcactcagagcacggtataccagtttcttgttgccttctctctcgtttctcacaaagtggatgtacttggagaacctcattcctagctcagcgaccacattcctgcgattgtctatcagggcccacgtgccccttttcttctcgaagctgaacagtcgttctccacaatgaaacacataccacaacttcttgctgagctcgtctctagcaatagtcaccgtctgagtaatggggcacaacgggaggacatcgctggagtccccacagttcttgaccacatatgcttccagctgttttcctccatacccacataagagggcagatacgcacagcgcagcagctatcggaatgatcatagcgagccagccgtacccaagctggtggagacgctcttggtcgtgtttggagatttttgtgagatagatgaagaaacacaagttagccaccatttagagtggacatctaaagcggccgttaccgcagaggattacagcagacagcttttcatattctggccccataataggggaggtgaaatgatagattgtgggcattcgactcatcccgttgaggatgttgaccaaccgttgggtctagtaaatatgcctacaacagtgcggggagggtcctacctgcatagggaaaggtggggatttctgtgttacggccttaacgagagataacctgatgggatggatggaacacgttacagcaatatgagccgtggggttaaggacaaacccgaacgaccggaatggtacagtacaaacatcagcttatcgtttgtgtcgaggacatactcgtattcggactcgtacaggaagccccagtatctataccgtgctactatgctatacactcccctcgtgtatcgtatcgcagagtcagacaggtcacggcacttatagactgatcaacagtgcactctttactgtcctcgttgatctgggggagcatgtgaatgttgaccttacgtatccacacgcatggatagcgcctgtgttcatctaccccactcgcaatattcaccagccacttttctttctgcttccgatgatatgatatacgacgatcgccacgcttttcgctcttaaatccgttgcaaccgttttgacaggggatctgcaggagtgagagagttgacaaggagaagcccaaagacactgaaggcacaagtacgaggagcttgtctgcacatttcagagataaatcatctcggggcacttgtagctcgtaaatagctcacgtggacgacccacaatgcgttttattaccacaccttgatgagctaacggcgaaaaagcagggagcacaacactacaagtactttacaagttgacagccatcacaccaggggcaacacctcctatttggtactagtactacagacaaacacagatgcattgctccttagacgcatatatctgtcaggccgcccaccagttttataatatcttgttctgtatgtactcgtacgacaagtcaacgatccatcttcttccaatactcttctgccggataaatctcctgcatttattataaccgacctataactgcatctctttaaaatctacaagtacgtaatacccacgctagcaagatggttaaactactggtacatactgtacttgtagcttttatgatgatgatgtgcacttttagcccccacaaaaagttaatctggtggagcttatattatgagccaatagaaatcaccaaatataactcatgcgacccgtacgttattccttgatgagtatcttatttgatttggagtggttcagggacgtagaaatagccccaccacggagggaaggggtctctattctgccgagccgtccgttcttttacgtttcaaaatattgtgagctgcatcgcatcacccaactctaacagacagttaaaattacgatcagtggtagatattgtccaacttgcgcttaaggcaagagaactgcttgtgctgctaaacccgttacgttcccgttcaaaggcaaataacagattgcggggaccccacattctgcttctcgtgcttgcatctcctatgtaacaagcgataccccgatccggagataacggatttgcttcggtgataaccgtctgaggtgcgtaccatccttcatttcccccactttctcgcttaatgctgtgttgccactctgaccacgcttaatgataggctttaacatggtgagccccttgtcacaaatctgcctcaggtgcttgagatatgcgctatgggtttcaacggtctggacagcacaaagaacagaatggcgtattattttactataataacggcggcagttcctctcttcttatctaaataacgataatggactcttctaaccacacaaatatgaatcgacacactcacgccctcattgttggtgctggcttctctggcctggcatcagccatcaagctccagaccgactggaacaccaccgactaccaaatctacgaccgagattccgagtttggcggcacttggcaacaaaacacttatcctggagctgcgtccgacattcctgcactgtggtactgtctcgctagcgatcccaaggtcgactggaaagagccctacccttctcaggaagagctgagacagtacatcaaggacgtggcagagaaatacaacctacgaaagcgagctacttttggagctgagatcgagaaggtggagtggctggccgaccagcaaatgtggaaggcatccatcaaggacgtggccaccggtaacaagtatacccacacctcgcgggtggtttttatgggcaagggctgtcttgttgttcccaacaagttcaagactgccggaattgaggatttcaaggggcctatcatgcataccgcccaatgggaccactctgtcgactacaagggcaagaacgtggttgtgattggcaacggctgctctgctgtccaggtgtgtgctgctattgcacccgaggtaggttctctgacccagtttgcacgaactcctcagtggatggtgccccgacctgaatggaagtggctcaagacgatgggtgaaaccttccccttcatgcttggatttgtgcgatttcttatgttcctgacactcgaggccaacttttcgctcttccgaggtggctggtatgcgcgagccgaccgagctgtccgaacctgggtcagcaccatgctcctcaagtggcacttgcccaagaagtaccacgagaactccatccccaaatacgagcttggctgtaagagaatcatctatgattgtggatactggaaagccctccaccagaagaatgttgaactgacttacgatcccattgttagaatgaccagcaatagtgttatcaccaagagtggccaggagtggccagccgatattgtcattgatgctactggatttaatgtcgccgcttccatgggaggtctggagattgtgggcgagactggcgagaacctggtggacttctggaacggcaaggtctccgcttacgagacagttatggtcgccaactaccccaacatgttcttcctatttggccccaacgccaccactggccacaactctgtcattttcgcaattgagaacgctctcaagtggatcgagaatgtcgcttctgatctcgtcaccggatctgccacctacgtcacagtcaagaacgaggcctacgactcttggacccagaaggtgcacgaggcttccaaaaagatggctttctccactggaggatgtgtttcctggtatatgagtgcctctggagctggacacaacggtgttacctacccctggactcagtttactgcttggtggagagcccgattccccgtcaagagcgatatgattgtcaaatccaagaaggacgagtaattaccacgcaagtgaagtatgcgtacggacacattattttagaaaatacaatattacagttgaacagtttttcgctgagagctgtagcttgtactgtatctcccgtgtctcatctctaactggtgatcacaaatcgtaatatatggagccgaggtgtccccccatgaaggagctagagagtatgtgaacatagactgtatatgagttgacattgaataattttggacgcaagacttattgctttataagtagttcatgaggacattcttcaacaccagcatgatgcctacctactcctattgcataccccgggcactatcagatcatcccttgcatgatctgcaacaagataagaacttcatacgctggtaggtttcatatcgctgcggggtatacacagacaaggcttgttcaacaaacaatctgctcgcttttttcactgaccgattttatggtgatatttctgacagttggatgccgaacgcaagtaaataagtggaaacagtggatgtatgtcgttaggagactacccaaaaattgaacatgggggtcaatgctgtagttctattcaacgcagttatcttcagtgtactctctcagattttcttttaattcggtgatctctttatgtaggtatacaataatcgtcttattctcggctcatggcaccccatttgttgattattaactggaacgtttgagtttctccccgcagaaacctaatctccatacattgagtctggggacgtattaaatcaggggtgagtgtatgaaaatgactcaattgagagtgtttttgtgcctatgtttttttgagacttgaaaaaatccattctggctcattttttgcgtgtttgttccatcacggagttgtatatccaccgactagccgcagtcttcgctaaccaaaattgtatgtggaactctggatgcgcgaagccaaatttgaagataggcagcgtggcctcaacgacaataataatggactcagtttacttccaatttgcgagaaaagcagctcataaactattgacagtagtatttcaactgcatcacattttccccaatctataggtccccaagatactcctctaaactaaccctccaggacgaaagagtcgtaagacacctactaccccaccataacccaaaatgatggggggtaatcacgttcctttggcaccgagtgtattatatataagtcagtagatccagaatgtctgttcctttcccaccagcgactttctctctcaaaaacaacatgactgagctctactctcactctctcattgtcggcgcaggcttctctggcgtggccactgcaatcaagcacatcaaggagtggaacaaccccgacttccacatctacgacagagactcggcctttggaggcacctggaaggccaatacctatcctggctgtgcctcggacgttcctgccatcttttattgccttacctcagaccccaagattgattggagccacatgtaccccttccagaacgagctgttccagtactttcaggatgttgccaccaagtacggacttcccgacaagagcactctcaacaccgaaattgtggagatgcgatggaacgagaaaaccaaggaatataccacaactctacgaaacgtcaagactggaaacacccacactcaccgatccaaggtggtgtttgtgggccgaggatgtctcgtggcccctaacaagcttaacctgcctggtctcgagacctttaagggacccgtcatgcacactgcccaatgggaccataagaactccattgtcaacaagaacgtggttgttgttggccacggttgctctgctgtgcaggttgtgtctgatattgcaccaaagtgtaagaccctgacccagtttgcccggtctccacagtggattattcctcgaatcgaaaagattcttcatcctggcttcatgaagttcctatcttacattccaggagcagtccaactaactcggctggtgctcttcttcctgctcgagtactcgtggaccatgttctctggagcttggtggtcaaagcttgacaacagaatcaagtccactctgacatccagatggatgcgatctaaagtgcccgccaaatatcatgacgtcattgtgcccaagttctccatgggctgcaagcgaaccatctttgatcccggttacctcaagcagctgtggcttcccaccatggaattgtcctttgaccctattgtcaaggtcaaggagcattcagtggtgtcccgaaacggcctcgagtaccaggccgacgtcattatcgacgccactggctttgatatccctaagtcaatctcaggactcaaggtcattggagagaatggaatcgaactggaccagttttggaacggaagagtgtctgcatacgagaccgtccaagtgcctaacttccccaacctctttttcatcttcggacccaacgccttgaccggtcacaactcagtcacctttgctatcgacaattctctggtctatgttgacaaggttgccagagatcttgtgtctggtaagcccaactgcacgtacgtgtcagtgtccgaggaggcctacgacaagtgggttgacgacgtccaggaggccacttctaagaccacctttggatcgggaggctgtgcttcctggtacctcggtgccaacaaatacaacggcaccacctatccctggactcagattcgagcttggtggcactcgcattttcccaaccagaaagatatcatccgacattaactgatacagtaagtggggagaacttaatttacttgaattgattgtatgtgaaatacagcgagtacagaaaattgtgtaattgtggtatgtattgtgtagctgataaaagtgtacatactgtactagtacatactgtacgatactgtaatgccatagtgccgtgtcttggatgtatggtttgaaacctagagcagctaaaagtgtatggtaaaacttccaataaattacctatgtaaatggaacgggtattaattactgtagatgtgaggctgtgcagacgtgggctgtgttgacatgggctgtgttgacatggcttctgtagggccgtgtgccatgtctagacctgggtcaacgactccttgccgaagccctccttgcccagaatgttgagttgggggtctcgaaccacagacaacttctcaggagaatgacctcgggctccattacgaagctgagtgggggacacagacagaggcatcgtgttcatgttgctggtcatgttagcttttcgtcggttgacagcgttcagggcactgatgatcttatccttatccaccaggtcagcctccagctcctcaattcgctctcgctggtatgcaaacaccttctctggactctgggatccaaacatggttcgggcttcctccgccgtgcccagctgcctctccagatgctgaatgtacgacttgtattccttctctcgttcgaggggatcgttaacggcggtagccattcgagcagagtgctccagtcgttctcggaggatcttgttctcgctctccagacgcgaaagccgagtagtggtaggaatgtcgtcagccgttctcgcagaggcacctcccttcttgagagtctcgatttcggctcgggcagcgtcgagctgctgctgaagtcggtctgctcgagcgtctcctcctagggtgttttgtcgaacactaacagagatgttcttggttctagcagcgaatcgaagagtctccatagcagcagtggcgtccccatggacagtgcacagaacggagacgagagacttgcccgaaagagcgggctgcaacagtcgagtgagcttggagtctcggaagggcagatgagccgagccagtggactggtcggaaagacgtccgataatcagagcaagagttagaagcgacttgttgatgaaagagccctcctttcgtcgctcgtcattgtcggcagcacgctcacttcctgccaagtcacacagatagagagtggcagagatggggggcgagagggctgaagaagatccctcgacggagatctggacaacggcatgagatcgtgacgatcgagcattgaactcagttccttctgttcgtcgacacgcatctccttgctgcaccacgtccagtagctgtgctggagacgtcacgagaacctccttgaggccatatgccctcacacctcggagcgcgtcttctctcagcttgatttcctccgacggtgtgccggggttgagcagatcgttgagatgctcgttgtaaatttccagatacgacactcgcaccttgtagtcgcccttggccgcggcggcaaacaaagtctcagcagacagggggatgattccgggatctgcctgtgtaccctgcatgctgtgagtttttcctgtgccggtcattccgtaagcaaagactgtaccgttgaagccgttcatcacgtggcctaccaggtctctgaccgacgactcgaaaacatctcggtttgcgcatcctggcgcgtagacattgtcgaaggtgaagtcgccgagatccgtctcgatgcgattgtctgagagctgcagttgtggagcggggggtcctgtgggcttagtggtcgacggcttgactcgtactcccacggagatggtgccttggtacgtttctctgttgcccaggggtgtctggggtcgtcgaagaggactgatgtctcccattcggttggacctcatggacattgtggatgcaggccgtcgaagcaccggtgtctgtggacgcgacggggtttggggtcggaactgtctcatgttggctagctttggcagagttgtgtcactagtgtcttcttcgtgattgtgggccgtaatatacttgttgtagggaatgttgtgggtatgtacgatagttaagagtgtagctgtatgccgcgctgtgtgctgcacggtgttgttgagaagtcaagagcccaaatgcaatgattttctggagtttcaaaatcttttcgtgtcagcgtcgtttttggggcactaacgggtacgacagttgttagaccgtagcgtgtcagatctttggtgtcaagtcgttgtttcgtggttgggatgttgtttttgcttgtgcttctacagtatattagcttcgccgacttttgatgttgatctttttcccaataggtgtttccggtacgcaggtcgcgcagttggcgcgtgtggcctagtcaccacaaccccctaaaccgccggaaaagaggtgatgcatactcccgggagttcaaataaaagcgacacgtaagaaactgaagggagacatgttattaatctccacgcttgagacaattttaacctccccatctataaggggggcctgcaaatccttctatttctgactttacccctttatcgagcatgctcacgtttaacttccacgaacgagaggtgccgccatcgatacgccaggaattctttgtagccaaagagcagccgtctatgacaagacgcacctgggtgtaaatgataagctaaccagtcgtataggagggtagcggttgtgcctgtcacatcacgtaccgtccataatgctgttaccgtggctacatctctactctgtcgccttgtataaaccgcgtttgtcccacgcgttaatattctcccccagcccagcgagcctcgagtgtgcaccatcaagcttcatactccttgcagggttgacaggggttagggttggtccctttaaattaacacgtagttgggtcatcatctttctcacaaccaacaacccaacggtacaataaaaaaacagacacaatggacaagctcaaggaaaagatgaactcgctgcggctcgagaccgatgctgcccaggagaaggccgacgaggctcttgagaaggtcaaggcccaggagcaggagctgctccagaaggaccacgagatccaggctctcacccacaagaactctctgctggaggaggaggttgagaagcttgagcagcagctctcagagtccaaggacgccgccgaggagggcgccacccatggtgctgccaacgagggtctttccaagaagctggccatcctggaggaggatctggagaactctgaccgaaacctgcgagagaccactgagaagctgcgacagaccgacgtcaaggccgagcactttgagagaaaggtcacctctctcgagcaggagcgagacgactgggagaagaagcacgaggagctgcttgagaagtacaacgccgccaagaaggagctggaggagatcacccagcagctcgagagcatctaggcgctcggacccctgcgatccggacaagctgccaatgcgcaagttcaagttcaagtctccccccgtgttaccctgctccattggatgtttatttctggcgtccttctgatcagtatgataattgtgatgctataaaaccctgaagggtgtgattgtgtaggtgtgtccgtgtctgtacacgtgtgttaatcgtgtagttgcagtaacgaattgtagagctttgattttaggtcaattgatcaggtatcacgtgttttggacctgaagatcgttcttttatgttgctgtatgcgtcgcctcagatatattgctgtgacgagatcgtgatgcgcatccgtcgtgtgaacgaaaaacaccacacgtgaggatatctacgttattgtaacgacacacaggtttttgtagggagatgtcaattccaggaatacaatcgacgcatttaaccccggaaaaatcacttttacgccttcatcattgctcctctgaacttggtggcgacttcaggctcgcgtccaggcttagctgataccatgtttttagctcagtagagttcagaaaccgagggatggatggttggttaaaacaggagttttaggggtatatgaaatatgagaggatttaaatttcgtccaacttactaaacgggactgaatatataatactaaatgcgtattgttacctccaaatgcctcattatctccgttaaaagcactcacgcaaactcttggtgattggtctttcagtggggttatgtggcatcatcacatggtcaactctaattctaagtgtgcattgccatgacgcttgaatcgatttcagatgggtggactattgggtgttggtgaatgctacaagcacagtatgtcgtaaggggatatggtttctgtctaatagggtgtttgtaaatgattgtaaaattcagactcccgattgtagatttgctcaggaccacagcttggttcctcctcatcgatataaggtggacgaaaagcttttgggttcgtggacttcgcgtgtgttgagtggatagtgacttggtgggtcagtaaaagtcctactgtattggaagtgggtacagtaatagaggtggaattgagccttgagggttccagttgtaggatgaggtgctacgaggactataatacttgcagttgtaagtatactacacacgtatcttcccctgtctacagtatgtaagggcgtatgctctctacttgtaccagtatgtagtagtcaatactgcaaggctacacctcttaaaaaactgtgcagttgatgtcaccaccacatacaaccagttcgaccgatcattactgattacatatcgtatatctggtatcgtagtctcctcaatacagacagatttttgccaaaaagagagacatcactactcatagataggttatgggcgtgttctcccaaccgcacgttcgttactacaagtagctacttgtaccatagttagctgtactacgtagtagccaccttcgatatattgtagctacttgtacttgtaccatatatacagcactatgatatgtcgtattgcactgtacagtattgttgtcgccggttccaaagcaacactgtttgtatcatatactaagtagttcgtacgatacacagatgatcaggttggaatcttcgatgcttcgctctaaagccccaaactcccatcatgtgagctattgtgctgtaccaatgtgtaagagtaaggaatacatggtcccattccgtatccccacactggtcgagccactattggggcgggttatttgaaggttgtatacatactacagctacagttcgtaccggtactgtagatatggctataccgtaggagtgatggcgcttagacttcctgtaacatgacctttggcacagtatcaatttgcacttcaatatacgggttgcctctccactgtatctcatgtctattcacatcggtgtccgacgcacagcatcagataaacaatcactgtaatgtggcgttgattgtttgacacatttgttacagcgtccacaggtgtggaaatgagttgtccagtctcttgtttcactctgcttcgttgattatatgtacctccgataccagagacgacaaactgtcaacaaaactagatattaaaatactgacactgtaccgaccaaataaagcactttgactgtctcaattcctggactaaaggggtcacatcgcctcgaactggtaagcggctatttttagtgctctctgcggtgtgtctgacagtctctgatcaatcaatcacgccaaccccagccataaagtttagctgctctcatttcgctcattggggcattgtcgcattgcgagattagtgcctttattatttacagttgcacagcagacggccatggtctgcgacacagatcaatggctggatcgctctacgaaggccagaaattcttaaacctgtgcacaaatactcgcatccgtaatacaatacctctcttttctctacccatatctcccccacctactaccctctcttcagcatgctgtccatgtgcatgcattatcagtcctaaacgggaaagtctgatacggttcggaagcaacccttacccaataaccccggttgggaccacggcaataaccttgtacatatatcgttgctactgtccttcttggcttcctcatcatccatcagtttctcagtgttcaattgggaatctaggacaagaacaaaatgaaattcacagctgctgtttccgttttggccgcagccggcagcgtttctgctgccgtctccaagtgagtatcacatcacctttgtggaggtcttctgtctggttctttaacgccgaaccccacatgggtggcgaaagttgagatgacagaccaaaacgatgagatgcacaaaaccgggaaaaacagtcgaggaatgagcattgaaaagaacgcaaactaaccgcagggtctctatcaacaagatgtcgactgccgagctcctcggaaaggagaacggtttcgaggaccatctccgaatgatgggccagaagtacatgggcaagttccagaagctgggcgagttcaacgagctggccagcatccaggacgtctcaaactctcccctcacgaactacctcaacgctcagtactacactgagattgagatcggaacccctccccagaagttcaacgtcattctcgatactggctcttctaacctgtgggtcccctccgtccagtgcaactctattgcctgctacctgcaccagaagtacgactccgccgcttcgtcctcttacaaggctaacggtactgctttcgagatccagtacggttccggctccatggagggctttgtgtcccaggacacccttaagctcggctctcttgttctccccgagcaggactttgctgaggccacctccgagcccggtctcgcctttgccttcggaaaattcgatggtatccttggtctcgcttacgacaccatctctgtcaacaagattgttcctcctgtttacaacgctgtgaaccgaggtctccttgacaagaaccagttctccttcttcctcggtgacaccaacaagggcactgacggaggtgtcgctacctttggtggagttgatgaggactactttgagggcaagatcacttggctccctgtccgacgaaaggcgtactgggaggttgagttcaactctattactcttggtgaccagactgctgagcttgtcaacaccggtgctgccatcgatactggaacttccctccttgcccttccttctggccttgccgaggttctcaactccgagattggcgctaccaagggttggtccggacaatacaccgttgagtgtgacaaggtcgactctctgcccgatctgactttcaacttcgctggatacaacttcaccattggtcctcgagactacaccctggagctctccggatcttgcgtctctgccttcactggttttgacatccctgctcccgttggccctattgccatcatcggtgatgccttcctgcgacgatactactctgtctacgatcttgaccacgatgccgttggtctggccaaggctaagtaagtgccgtagcattctatataagcatctaatggattataacttcgtatcttaatcatctgcagacgtgtacaatacttgcgctgcccaaaattcactatggtaccagcaatggacttctacaatagcagggatttagcaacttttcacacagtggtacatcttgcagtcagattaataccaccgttgcacatcattgaatttatgtgcaaaagtagcaatacttttatttttactatcacatatacacagacgtagctacttgtacctgggatgggcagtcaaaaaatgcatatattacaatcagtattctgttcgtcggacgctcacttgtcgtccgctctgaagagtttctccatctctcttaactccacttcgagatgcccgtcgtgacgactgacgagagacctgtcgaacaggagtagttacaactccgttgaaagcccgagagttgaaatcagcacgagcaagctcggccctggcctgctccaaacgcttgagttctcgttcggtctgctcagcgagcacgtgaggagaaatatcctgggtgcgcatgagcttgccagggcgggaggtaccatcatgatagctgtactcagggctttcaatattgacgagcatggacagagagccaccctcgacctggggatcaaggaagagatggatgatgtctccatgttgaagctgcactgtgttgcctttgccgatcttctcggagttgactctaatgccgtttcggctgaaatcgtgaaggaagatcctgaagaagccgtcaagcttggggtcagtcattattcgcttttcgaagatgcagtgttccttggagatgggcgccttgtctatcacaatctggttgtcggaaaccactcgtccaattcggtagttgtctccggtaatgtcaaactcgatctcgtgaatcgtgttcggcaggctcttgaggttgagccatgtgttgggtctggctcgtcgggtcttcgaggcggaaggaatcttcaccacgctgccgtcttcaacgtcgctctcgtcattgtcagtatcagcctcggccattcgctgggcctcagcttcagcacggatccgagcagcctgctcagcctgggcctgaagaatagactggttctcagctcggacacgagattccacctcgtttctgattttgcgctcaagctccttacgaatacgagcctccatctcggcaggggtctcatgcttttcctcgcttccagtgccgtttcgatcaggattaacccaactgaagttggaatcaacaggacggtcgtgagcctgtactcctccatcagtatccgagtccatagaatccttttcgttcagaagctctcgctgtcgtcgctcctccataacggcatctcgagccatctcagaggcagctccaccaatgcgagtttcaacattgtccgtgagaacaagaccctcaacagaaatgggctcacctcggcttcggatctcactgtcgttgtcctccattagaggtggcatggagttgggatcaggaccgtctccaatgatggtggctcgtcgaatgtcctggaacttgtcagaatccaaggtggcctgaggagaggcatctccagcttccccctctgtaactcgcagtcgaacagagtcatcagagaaccaggggtggcgcagaatctgaatggccgaaggacgctcttcaggatcaacagtgagcagacacttgataaaatctcgacccatgggggatatgttgaagtcgtttagaggcttctggcagtaggtaccggcagtaatggccttgacaatagcctcatgggaagtgccatcaaagggtaagtatccggtggccagaacgtaacacagacagccaatactccacatgtcaacgaggttggagtagcaaccgggatcggcgctgttggcttttcgtcgttctcgagacaaaagaatctcgggggcaatgtaggccatggtaccacagaaggtgttgagaatggagtcctgggtgactttggcgagtccgaaatcagacaccttaacaataacggggtcatcctggaagacgagaatgttatcaggcttgatgtctcgatgcgaaacgcccatagcgtggaaatctctaaccgtttcaagcacctgtttgacgatctcacgggtgacaaactcaggaatggctccaaactcgctgatgaagtccataaggtctccgttctccatgagctccatgaccaggtagtgacactggtcgtcttcaaagtggtcaatgagctgcacgacgccgggatgggtaatccgcttcagaacacgaatctctcgctgcacagctccggggttcttcaccttggacttcatgatctgcttgacggctcgaacaggacctccatcacgggctacgcacttgtacacgttggcaaatgcacccgatccaaggagatcattggacatgtcgtacttggcgtgaaaagagttctcgtcgtagggcacttcggtacccatatggtgggtaaagatgaacttggtttcatccgggttgtcctgggtggcaacgccttccattgctccaacggtaatcacgtctccgttctgcagaagagcactgttgccacgtcccaagtaccggccattgacacttgttccattgagagacacgtcccgaatgacaactgtgccagctcgttgtttggttcctcctgtatgctccacgatgaagtggatcttactgagacgggcctttcgggccacgacaaaattggcggatccagctcgcccaaaggtccagctctgagagcccttatagtctttggccaggttcagaaagacctcgtcggtctcctgttcatccatgtagtctttgcctcccgcaatgatcttcatgctaccgacaagaccggctcgaatgtcttcgtctcttttttcctgacgactgtgagagtttctgcttgccaggacggctggtcggtctggctgagttgatgagagctcgttctcagcttcccgtcccaaaacatcgtcgtactgcatttttgattggctggttgatgcgagaggggcagaggactacttgtagctgttggtcaagttgtcgtggagaacaagttgggtgatttgggaccaaaacggcaggcctccttctttttattgtccattctgcaatgcacacagtggaacccaactttatactgtggaaaggtggtggcaacaaacagagtctgtaaagagatatttttgttggacacgaggggtttatgaaggtgaattatggtctcttatacataattactcgatacttctctgttaaattactcgaatacaccttgaaaaccatacaaaaattctccctctgctgtcagcatgttttggtgcatctacattagagttgtcatgaagaacatgtgtgtttgaaagatgtgtaacgcgttgtcattgtgaggcagaatactatatttttaagaggtgcgacttggtgagaatgtgttggttgaaaaatatttttttccatcgtaaaccgatctccacacctccacttaatgaccatgtgtcatcgtttcctacccccactcgagactgtgatttgcaacaaagttcatgcgaacgcgtttggccgctgttctgtacacgctcacgaatgagattctccataccaggaagacagagaaatattatatatgacaccagaaacattttacacacgcctagaatgtaccttgacctaattattctctatcttcccctctacaactagggtctctgtgaatctacaataccaagtcacttcgtcatattattttttatgatcaattaagcatattggagtcagttaattagtgctgcaggccgtcgttggggtaaccaatgtttatgacgaggggtttgttcagcgggcagtgtctaaacgaggaataaaaatatttgacataagaaatcatatcaggtgaaccattggagacactttttacccatggatatcctgtttttgctcattccacagctcacatttgagttgctcagccattgacacgatttcaataaaacgcgtacagcgtgtacagcgtgtacaatgcgtgcatatcgatgtccaccagggcgtgggttattgacaattgcaattggacagtcaggatgcaagtagttgctgtttcactctttgcgcgaaaataaaacaatccaagaaaaagcctcttattattggcatcaattgcagctccacacttgcagtctgggagagattatgcatgtatgacaagagaattacaccatgcgcagaattgaagggggatggtggcgactacgaggtacagtatatacactgtaagcactacccttagttttttttttttacatatcggaaatacagtcgtccacggcagggttgtaatagacgtcaaaacaaaaaaaaaaattttatgaaaaaacaagcaccaataaaaagcttttgtagtactcgtaccttagtctgcatacaaatgtcaactgagggattcgaaccctcgcctcttgcgagatccgaaagccagatttctcttgctaagcttacacttgagtcggacgccttagaccactcggccaaattgacagatttttacgtttttgagaaatctggccactgccatgggtcatttgctgactaaaactgaactgtgattttgacgatattatggactgcagacacgagttaaacagatactgaatatgttgatgagacataagacccttttggacacagttttgaagacaaatgttgaccaccggaccaggaattcggatcaaacgagatctacggagaaaaggatctacatgatactgaactttatgagggctatttgttgattgattgaatattatcagaagatcacatactccaaaggaccttcagaaccctaacgtttggaagctcagcgtggtgaatggagagctacgaagggctggtgagacacttgttaaataacgagcgatatgatgtcgtggcttaataagggacacagctttcaaccctcagcactatactgtcttcaatcatttgactattataagtatgtacgagtacaagagtagtgtacttttagacacgcccaaggactgagtttcacaattcgtctttttcacctggggtaacctcggacaaccacgtcgttccaatgtcatagtagagactctgtctgaaaacttcatcatcaaagctcatccactctacaatcatacttcaacctatctcactggcccttctttcgagtgcttcgaccagcattgtgatatgcaccaccctcaaccttattgtcccccacatgcataatctcaggcgtctttggcgatttacaggtgcgcgacagattacattttttgcagagtgtcatacgagttgctacgacgacaacaacacaaaaccagacgcattcaggctcagggcactgctgtgaacatctaagaactcgacacggacaagacacgaccgcttttttaagctcactcaagcaaggtccaatgcctcctcttcagattgtattggacaatgcgtaccagcgtgccttagtattgtacgacgaaagatctaggcaggtggagctgattcacgatgaagagcagtatttacagctgcgatctagcacaccacagagatcacagagtccattctcagctggtaacaacagagaaggtcagcttattgtaggaaagccgaaacgaccttcggtttccccaccacgacgccactctgaaacttattgtgtgacatgcggatccaagcttccaagtggattcagacagcgaccaactgcttcagcgaacgacttcgttgatcgcaactacttccaacttctggcaggagacttacaacaaaatcatctgggctccaacaccaatgccacggggagagctaagaatggcaccttttcaaacccggtgtacaatagcatttctgaaaatgcgttcctgcagggttactttgacaagttctttgaactgaaacacgaattaggccgaggaggacgaggaacagtgtggttggtggaacatgttctcaatggggtttcgctgggattgtttgcatgcaaaaaagtgccagttggtgatgacacggtgtggctgacaaaagctctgtacgaagtgacattgctgaaacagttgaaccacccaaatctcatccgatacaaccatgtttggttagagacatctcaatggtctccatttggtccagctgtcccctgtgcattcattcttcaagagtattgctcaggaggcaaccttgaggtctatgtaaagaagagacgaactctgactccgttcgaggttgtgagcttcttaaaagatatattgtctggtgtttcctacttacatgaacatcagattatccatcgagatctcaagccctccaacttcctactcaaggatgaaggaaacggacctggaactcccccgcagattctggtgagtgactttggagagggaaatgtcgaaggccagcatagatcaagtacaggaaccacaggaacattggaatactgcgccccagaactactctcgcgtgacataagaggaaacctcggggagttctcacggcattcagacatgttctccgtgggattggttttgtacttcctgtgctttggtcacacgccatacagatcccctcgtggagttgacagtggtgcagtgaactttgaatcattgagagaggaaatatgtacgttcccgggatatgaagatggtgaagaacaaccaaacttccctattcccactgatctacagactttgttgacctcgtggttatccaccattcctgaagagcgcatcagtgccaaagatgctctgtttttgctcgagaacatggacatgagcaccatcaccgtcgacacgactctgacgacacgaagactgtctatcaagccagtggtcccggatagtgaagatgaagatgaggagctaattggacaggacttctccggtgaatttctgccggaaatactcagtttgagaggagctgagaagcaacgaaaagcacaggagaacagggtcatcaagtatggcatcaagggctgtcttctggcaacgaagatagccactatcgagaaggacaaggacatgagtcctgttttgaggcagatgttaattctgctcataggtttggagttgcctcttagcgctcaaatgtcagttgcattatttgggcttcacatggttctcatgttggttggttactacggttttctgtaaattgacggctctactgacatggtgatacacatggttttgtgtcccagacattagctactggtaactggctcacctccacatacatagctactctgcacacatcatcaatctcattatttcattactatgcattaactactgtttacgtacgtcttcttaacaattacagccttgggcttcggttcctccgttcttattgaggtccactcccttggcgctcattctgggtcttgcggtggagttctcgaatggcacttttcgtgcgatttctgtaaacagctccagcacattctctcctgtcagggccgaggtctcaaagaacagaagaccagcctcctcggcgtaagctcgagcctcctctgtaggcacctctcgcttgtcctccaaatccagcttatttccggcaaggccaataatgattccgtcagcagctcggtgctggagctccttgacccatgccttagatcgctccaatgacgaggcctgtgtaatgtcatagaccaccacagcacaattggcgttccggtagtacatgggggccagcgacttgtatcgctcctgtccggcagtatcccaaatctcgaaccggactgtcttgttgtcttccagagagacagtctgggtcaggaaggctgctccgatagttgattctctctgctcgagaaactcgtccttgacgaaccgggtcaccagcgaggatttacccacaaacgattcacctgtgttagtaacatcaagcaagtgacaggcaaagcggttctgatacgaatctgacctagcttgcaccctttcttgtacccaaagatcacaccaaagatgctttgctccattcccattttcttcttgtggtggagtcgctgaaagaagccagaagagagtagcatagaccctctctcactcacctaataacacgagtttgaactgtgcaaatcgctcttgagaagacgttcttggggtggccatgttgtattgtgttatcgtagtggcagtatgatgggatgtggttatctgggagatacggttcggatcatgtgacgtggtactgcgtaatgcgttgtggtgtatcacagcatgagaggtggctgggagcaaaggtatgatacttgtaccgagggttacgagaggcggaaaacagacgcaaaaagtcttggcagaatatattacgtggaccaatagtttgtattgatgtaatgtacagcacgagtgcgtaagtccctacaaatctacttatcatcgccaatacctgtactccgttgaactcatcccatataccttggtcgccaccctcccctgtagctatttataattggtaccgctggaacccaaaacgggtaataagtaaagcagtgcactgacttcttgacatctgaacacttgacttgcctgagagggggacaagaaaaaacaaaaaaaaaaaatcacggtgcagctgtcagcaggataaggacgagatatcgtacggatggcgaacacaagagtaatcagcttgtgccatagtgttgtagtataatatttcaatcgtgttatgggcaacacatcacagtgcgactctcactgtatataaacgtatgtatcgtgccagtgttactcatacaatacaggtgtacagcattatgcgttcagctagaaatcaccagcataccaaaaactgcttaccatctcctgaccgggtaagttggcagtcagttattatttgaaaacgatatatatatacagtatatatgacacccttcggccttcggcgctcgctgcaatttgggcaaaagttatccctccactccttgtacaagtacgaacgccttagtctcgacaaacttgctcattatagaccctctgatatgagacctgaagtcacgacacccagaaatgcctccatcgcaccacccaaccccagaggtgacccaaactaaataataagacgccctgtgtgtcacaccaagcgcttctcgattgctttgactgcactccaacatcacaagaccctacttgtagtgtcttacagtaggtaactcggtgatgtgcttcacggaagagggctttacttgacccacgtccaagtgaaacacccttacaactctgaatgcaaaataaccagagtaaaaacccacaatggctgctcatagtgagcattactgtagggctcgtagtcaacgttagtcatactataatctacttgaagtaagtgggttcacaaactatagcgataccaggcgcccagttgcctcccattatacttgcaatctgtccaagaaccaactactgtaccacctacaggaatattaccgtgtacttgtagataaaaatgcaataaataaataaatactatgtttcatgggtgaccgaggtttctagtgcatcctcgtctacgtcaccttcacaattttcacaatcgtcccagttaataggaacccatctcgcaggcacctgtttctgggtcgtaatgcatcgcttgtcgtcgaactttgtcacaaaccgcttacgaatgccaaaaaccttttcccactctccatcaattccagccttaaggcggtagaaggagtcgggattgtcggttcgaggcggcagcagcatggtggctcgacccacaaaatcggggtccagcttgccacgctgccgcatgagagcctcggaagcatacaccctcagaaagtcggggttcatccggtgctctcgggggcgaaccacaggcaaaagagtagagctgtagttgtatgtcttgagaggaatgtttctgggagaagcagtggaggtagaagtggcagtagcagcttcctcgtgagtacaaccagcgttgtcggcagcagccgcagccgcagcttggttcagctcgtcagtcataaccatacactcatctgtggatcggggagaaaatgcaaacaacgccgagttggaactcacctgggcctgctgagacgtggagaacttgctggcggcgttgctgaaggccttgaaagacttggtgatgttggacaccagtttggaccgcgtggaggtcgaagtggtagccaccgcagctgcagcagaggcagcagaggcatcggcggttgaaagagttccatcgtcggcagtagcagtacccactacagagccgctatcgtgtgatgcaatggatgcggccttcttaggatagacgtagtccaccccgctcatgtcatcatcatcggtgaaagaggcaaacgattctgtgcgggggaagcccagagagggggcgtccgactcgtctccaaattcggagtcgtccccaaactcagaaagaggatggtccgacacgggaatgggacatgcacatgtcacctgtcgcgacgaggatgagttcttgctcgagaaggacagcagagaagttcgccgtttgggtaaacgggaaagagcacggctggaggcagcagcagacatggtcccggggaagttgttgttagtagagggtacggcagtgccagctgacgtagcaagcacaggtacagtgttgtttctgatagtagtgacgccatttgtgtcgctagtgtttgtgttggtagccacgttggtgtcatcttcgttggtggcagtggcggtggcattgtcagtgacagcgctagtggccaaggcagggtcatagtcgatgctgctggctgagctaatggaactagcgaacatgtcgtcaggagggctcgtggcataataaggtgtctgggagtcccgagccagtccagagagtcgctgcaggaggccgtttgtgtcattgtatgtctggccaaacaaggactcgtactcgtcgtcgtcgtcattatcgtttgattctgatgaatacaccatagacaaatgaggtggggtgatggaaagacgacccagagtgatgcccgtgcccatgacataagggttctcacgctccatgatagtcacatgagaccccgagggagtaagatgtgtagcaccacggacgatttccgttgtgtcagcaggcttgttgaggctttgagtggtggacacggtggaggtcgaagacacctttcgtgcgttcttgtgatacgtctcatcatctccatctccgtcactccctgcggtgtccaaatgtgaggttttctttttgctcttcttccgtcttcgtccgatgggaatctgagtcgatagtagcagctcgttgacgctggggttgattgtacggcggggcactgcagttagccctgagcccctggtttcaacagttctgaggttcataggctgtgtgtatttggtagcaatatcgagaaagtcgagaaattgttgaaatgcgcgggttgtcggtttgaatgtttttttctgactgtgtcgatagtcgatagttggggtgcccggaaagccgtttcagttgtcagttacttctgcctcgatcaaaaagatgaaaaaaacgtggcaaggtgaagcagtggaaagagaaaggacagcgtcgtgtatatgctgcaggagaccgagtaatgtaacttgcaccacttgtctatatgttgttgccacccgctgttgtgtggtgataggggccaacaatcagtagataaatgtcttctctgtagccaaagcgaatagccaccaatatattgttggtgtagtaattaggttcacaaaaggaaacgagtcgttggaggcttatttattccgggaaatggcgctactacaattcagactcacacactaatctgatccatgcgttttctagatgggaagttggagacacgccgagcaagtcacgaaaggggtctaatttccattggagtccgggtcgggtccttttctgggactacgctagcgctcggtcaccccctaagccagtagaatgtttggcgttgccttcttccatgcgataaacgcacacacaggtaaaacagagaaccgatttgcacatatcactttatcctagaggttatcgtggttggggctaaagatagggtgacagatagcttattgtagggggcagccagaggctaataagcaacattcaaagtctcgaaatgcggtctttacgagccgatagcaagcccttttgctgcccctccttctcctgggccattacaaattaatctcgtctcaacactctacaccaatgctgcatgacctacctgttgttaggtgcgcaaaggctgcaaggtgtgtcatgtctatgtgggtcctacgtcatgggatgagccgcaagcacaagttgcaagagagcgcattttgttacacgagcacaagcaatagcagcacagcttgtatggacatgacagattttttgccccaaaattgctaatatcgaaaaaagtggaccacaacccccaaaaggccctggctcagggttaacctcccagtcggaatccgccttctcaatccagaagagcttcggcttatctggctgttacccggcacacggcattagcggacaacaaggtggtaaacggctctggccgatccgaggagatggggttagggtgtgactgtgtgaagcgctcccttctcccttcaagaatagttgtggaggcgccaaccaatcttccaagaacaaaaaaagctctgcaaaatcgtctgtatcaacataaaaaataaaaataagacgtggctggggcgccactgagcagacccacacagccatacagaagatcaaagacccacccatataaaaggagaagtgttatcctgttgcttcgaatacgatacataccgctcggctatgtgcatcaccgtcaggacccataattattttatccactcccattttggtccttttttttgactcttttgtcgcccatttttgtttacgtctattcttttgtgttgtcttgtttcactggtgcggatcgtgaagtgcggagtccacacccttgccgtttgccgctgggcttgtgctctttgtgggtttacagtgcaaccgcaaacccccctacagtgtgccacgtgggtggcaatgaggagatagagccaatctgcatcagtgagagccctccgataacaccagaagagacacgtaacattgagagcacaaggccgtggctggggtgacaacatggcggtgccatgttggtccgagtacagtaagtggtggctatacaccctctgcgagtggtccaacacttctgctctgcaactcactatcattagctacatgccacaggtacaacttaactaagcgctggcttttatgggatttcatgagtcggaacgttaacacagctggggtaacctctaagcacatctggaaaacaaatgcgaatgcatggagctctcagtcggtcccctccctgtaatgcttgcccaaacacgaggtgcgatgcgaccttctcgccgctcggctcggcatcttttaatgtttcatttaacgtgtacaagtacaacattatccaattatgacagcaaagatcaacttgattcctccctgaagggctctcaaatcccgtattgtaagtacgcccaataattagggcttatgttgcgtattagcattccatggaataggaggttcgcctattacagaaatgtcttgtagtcgccatagcaagctataccaaacgcaatcatcctatcgcgagtcagcccttcaattgacagtttgcgtgctaccccccctgagttctgtttacctgactgtttacatccgcggagacgtcggttgaaacaaaaaaaaaatgacagaatcagtcatcggagaagcggaaccagtgctgcgtccaccatgctacataattttttagactccaaattcccgcatagtttctgtctccccaaatctctgttttacgtattttcttaaccctaaccccagttgacaactgtggggggacggacgggacggagtatgtcaatctgtagaccccgtgtggccaaaactaccaagaatgacattttcggttatcagtgctatcacagtttgccccttgtctcaccatccacatagttggcgtttgttagggtgaaaatcgttcacttttgaaccgaaatgctactgtacaccagaagtccctggtatgatacttacagtatgtactgtacgtaccagaggctattaaggtcccagcactgcctgaccaagtcccaacgaaagtagttacgtcttggcccaaactctggttaaaagccgctagcgccaaagcctaactgcattctcttgagtggaataagatgcctcgttctggaacaagataatacgtaatacgacagaaaagggaatctaagcctcactgaaaagggggaaatacaccggcctgagggactttatgagggtataattaactcacgactcctttctgacataggacgtccgcacctttttttcttcttctttcgtgcacaacattgctaaaagtgcatttccctcccaacgggtttttcctcgtgtacgccgtagacgtaagggttgcatggcaatgccagtgtacatgctgtacttgtatctgtccttttttttcagtgcaacagatcactcttgcgagccataaaagcaaatgcgtgcataattaatgaaatgttagagtgccgtatgaccaccagtatgcgagccccattacccaagatttttcagagtgccgtacgagtacagatttggagtgcgtgagaatgcagttcagaaaattgtgccgttcaataataagggtatttattgctcatacggttattgagggttatgagcggagtggtatggctcttcacacgggcagatataggggctgtctctacagttaagaagtatgtaagactgcacccccgccacaggtaactattactaagcgtagaacctggcttatctcactcacgtctgcctctggcatctgtcatctccatctaaaacgtcatggaaaaagtcaatgaattcataatggtggaccttgtcaattaagcctctctggctgtatgataccccggtagcagatcgacactcgggatgacagccacaatcgacgatatcaatgtaacctctttcggtggaggcccagtgccgtgcataaccttgtaggtgacaactccgattattgatatcacgcagctgtcgttatcatcagtattggtaattgctttatctaccgtacatacccgtggttcctttgtttgtttccgatgagagcagtttataaccccagtcgccgtgtatcggtgttcattgtcgatgtggcttgaagtctacatgctgtaccagtacaagcactgtagatgcagaagtgtttccttacaataagcggtgattgtcttgtagctggagattgggtcaaggagaagacaatggtcagaaaaggcagcgataaagagctgagagacagtaattactttcttgtacaatagtgtccggggtcagctattgggtgtcaatgggttggtacagagcatacaacagagtgcaagaacttgaaaggactctctgtgtttggatacaaatatgtacacttaggtataagtatgaatttggttagctgctctactcgtggctgcgacgaccaattacaaaggcccataagggagacctgatgtgctttatttaatcactgtgcttgcatcttttctttacgaggcactatagctatctatggagatatcgattccacctctacttgtacctggaacaaaacagttggctaaacttttcacgctcagtattctcccggtcagcttatactgtggaactcgtacggactcatacttcccagatggtataggtacattgatgtgaattttacatgtataaatagatggccttgggcttttagcaaggccggggccaatttgagacgcggattattaggaaccatctccaagccgattaacaagaccctctctatgtgtcggttgagctgaggtgctcgtgcctgcttggggtgtttccgagtgggaaacagagtcggtcagacgttgtgtaggagcgggagcagcatagtcggtgttgtgctcttccacgtagacgtcttcagtctgttcgcggctgttatcaagccatctttggacgtagacccacgggggagccaacggtctagatccgcctgaaaacttggggtacacatcttcgaggaagaagatgacatgaccgatgaacataccgatgagctcaaagatgagggtcttgtctcgtccactgagtccaggctcctgatgcatctcgtcatggtgagacaccttgatgggccggcctcggtggtctcgtccaggaccctcatcgttggcaatatatgacatggccagagtgacccatggcaagtagggtgccgtgaaggtgaaaactccgagcagcgagactcgaacgccttcgtttcgtcgagcccagaggtatgtgatggctgacaggagagaggatcccaagaacggaggcgagatcttgggaaatgcaacagctatgagcagcaggttggcggcggcaaagagcatgatccacgcatactcggccacgttgtgtcggtagcaaccctcctcgagcattctagggtggcgggagagaaagtaggctctgagggccaggtcgatattgagctttccaaaatagaaaaacggcgtgacaaaccgccagtactcgtggcgttgcacaatgcctttccacagaaagatgtagtggatctcggacgcaaagcccaaaaattgcagcagacccagagtgaacactcctccaataaatgtcatggtcacggggggcagctccgtgagctgttgtacagccatgtccattttgaaagaatctttttgtgtcggtggttcttttcttttgtgtgctgtgctgtttggaaaagagtgtggagatgtgaggtgatgtgatgtgatgatgtagtgatgtcagagaatggtgaagtgacgtggaggagaagcaatataaggttgttatcgagggctcttgactaagctcagtagagttgcgccgaggaggtgagaaggggtttcggagtcttactgtcagtgtattcgtgtgctggattgtttatgtttttttttcaggttgatattgtttgtttttttgtattgaaatcggcatttagaagtcctccttttcgctacgatacaaatacctcctctctcccaggtacgtatgtactctatggaaagaggtccgatgattgagtctaagtgtctcaacaaagaacgatgtgaccccagcttgacaagtgtaattaacagagtgtgagcatttaataatttcgatagatcaggaagatgaaaaacacagaatgggattcattacccaggtaaaacttgcatattgtatcctatgtacagagttccatcacgtatccaaactaccaccttctaacaccactacagtattacaagtaccggtaccacagggtactctcttacaatatcgttttcatcgcaccttctctaccccttcccaaattaatttcttcgttctgactataacttatatacttgcaacccttggtcacttcttcttggccatatccttcttcatctgtcggagatccggaggctgttcgattccaagatctcgtctcagctcctcggcgtccttctccagaacctcttcccaatacacattaatgacaggtttggatcggaagccattgtagagagcccagggaaggtagacgtcaaagtaccgcttgcgctgcttgggcttgaacttaagaggagtgaggaccatgcccagaccactcatgggcagacctgtattggcccattcgaacgccttgagagccagctcaccctccatgatgataggcaaacccgtcagggcatggtagaagtcatgggactcacggtatcgctgcatgacataagcgcactcgggatcgtcaatgtatcgcacctgagctcgggtatcaggtgagaccccctccttgtccagccactccacgtatgttcgtccaatgcttccgaccttcatgtttcgcagtttgtcgagatccagactcttgctggtcattcggggctgttcgcgcagcagacgtcgaccggtcgggtctttgagcatctgctctcgcagcttgtagatgaagtaaggctgggcggttgcttctccaagagtggcaaccagatcgcctcgtcgagagtcgaaaaaggtgccgaacccactgcctacagcaagcacggctcgtcccagacacgtgagaggcacgtgttcggggtatgccttggggtagttgccgtttaagagcgttcggcgctgaattggcgccaatagtgtggttttgggcaccgttcggaacatgtttgtacgcttgcaagagaaagtgattcacttagagttggtggactgatgtgagagataaagttgatgcatcaagatgagcaactgtgtggtgtaccaggtgctctagctacgacacaagtggggtagaccattgggaaatatttagtgtccagattaataaaaaaatgttatagacttgtttggatggtaatttttttcccgaaattgtgactaccggtatctcagaacgatgttgtggtgaggactgtagttaagaatgcatgaacagtatagtatgatcactgaacaaccctcatacgacctacattgtatgtacttgtacctacagtaagtgatatatatatatatattcttcgaacattgaaaacgtaagttacacctaatagacctcatcatatcatatcttcaatattccattttatgcaaatttctcttccttccttcatgtcaaaaatcactacaagctttcggtacagtatgtacttgcgctggtaagttcatgattcgatgtgcagctcagacacaatcttccagccataaccacacatcacaacatggcacatctatcgtggtacctagacgatctgcaaacaatagtgccagagaccatttccaacggtctgaagcaatgtctgctttcactcacagcccctgaagactcgcccttgcctccgttcaagctacccgtctcatcgcacgcctcggaaacactcaagggagttgtctgtcgaagtggagctgctattaccgctactgacatccaactgaaactccattcactgaaaaacaaatcgttcacagtcagaatcaatccaaaaacagacggataccaactcagccagatcgacagctgtatcaaccacgtcagcctagcattggaccaatgtgacgccattatcggctcaagagatccacagtacctcaatatagtagcccaatcgctcatcaaacacatcaacgaagccgtggcgtcaatcaactcacctgtcgtgttgctagagaaacccactgaaccggctggaggaatccccagcaacaacacctcgcgatgtgctacacccaaccccaacatttcgcactccagtcagtctatccccgtctcgctgtctggaactccgcactccacaccctggctgttccccaacactcctccagttgactgcttcaacccaaacctacctccagaactcattgtcgagttttacattgccaagtgtgccattgtggtggacgtgcatgttgtggaccgaggcatcagtcgagctggaactccctcgcagaacccttcaccttcttcgtcttccgcaaacttggctgctctcactaacctcttcaaacgagctccggtagcctccaatacagcccccaaaatcacttacaacggagaactggtgagcgaggtggaacgagtggttgtggatacgaaagatcccattcttatgtcgatagaggccaagctgagcgcaatcaaatctgctgcttatcgtctccatcgaaatctggctgcggtatcaggtgcttcagaagctgagcaagttatcatgcctgtcacagaggtatctgctaactagagacattatttcagcaccttatctatttatttattcaacattacacataccgtattaatatcatcattatcgtatttcatactatacagctgcagatcctacgccggtgattccagctacccaccgatcaatgtgttctcggaaaaacttgttggccacgacaaacccaattcccagcaccaacactgttaatgacgcaaacatctgcttcttgtgtggcttgttgtccttatgctcatccagttgctgcttgtggtggtccagctgctgcttgtactcgtccagctgctgctcaatcagggacagctgaatggtggaagactctgcttgttgctcagcaacctccgctcgttctcgcagccgggagttttcagcctttgtatcagtgacttctcttttaagctgtgtcaacacctcactgtcagaagaagggttggaaacagctccaacaactcctgctgctgtagccacgccggcagctccggaggcagttccaactgctcgtgttcgctcgagttctgtttccaagtcgcgaatcttttctttaccctgtttcacctcagcttcgagctcccgcactcgctgctgcagctccacactagcatactctttcatctgctcgtttcgttcgtccttaagacttttgtgtttcttctgctggctttggatctgcgatagcatcttgcgcacactttccagcttggctgtctccacacgcgtgctgtggatttgttcagcgagagtttttactgcattctcaatgttggacgacgaagagatgcctgacttcatgaagagacccccgaccgagttgcgagagtggcccagagcaagatcctccagagaagtgtccacatctccgaaaagtgcaacatcaagagcctcggccttcttgggacgtgctcgagaaggaggaccaatcagtgtctgctggccttgtgaggtaagtgtctggttttgcgttagttgctggttgttcccaccgttgttttgagagaccactccactgccgttgctcaggacattgacctgcgtgagagacgagtctcctgactgcagactcatgacactgattcgttccaccactgcgctgattttacggtgtagaagagccgagccatcgttattggcgatgtcgattccgagctcgagcagatcgtttcgcttgagctcgtggggttccgattctcgtccatcttggctcagacgctcgccattgatatatgttccgttggaggactttgcgtccttcatccatacttttcgtgtcagtttgtcggcccagatctccgcgtgttgtcgtgacagcaccctcgagtcgaagtagccattgtcgggtgagggtagagtcttttgagacgtctgacggcctagtttgagcacttcgggatagaatggaagtactagagacttgcggtcaaacgtgttgtttctgggagacagtacgataacaacacaatattgggtacgcgcgggcgtgattcccagctcgctggcggaagatgcagacgtgtttcgagttcgacgtctggggggatccgcaggagcatttgtagccgtagtggcgttattgttattgttgttgttgttggtattgtttgatgcagctgctgatgagatctggggtgcagaggttgatggagctggagtggtggctgcttggatggcggtagaaacagatctgccaggtgtgcccgtaggtccctgtgtaacactcgagacacctgtagcgcctgagactgcagttggggctgcggttgtgggcgcaccaccgccattcactcgcttaggagcaatagacgaggaggatgaggagttggggatgctggaaatgctgccactggaggtactggcgcccacagagctggccccggcacttgtggatgtggtagaggccgtggcagacgcagtgcggggatagacggagggcgcgttgaccggcacgtctcggtctgatggctggacagtcgccgagctgtccaccgagttgagagacgacactgaacgtgcggatcgtaaagagccgttttcacgcatgtcgtttgtggagagaaagaggctgaggtgttgtttgtggagaagtggagaagtggattggatctcccactgatatgtatcgtgctggtatgtgttgcaagctctctgtcgatgccaagtgtcttttatgagcagatgttgtcacaccgcgttttgctgtttggtctgtttggttctgcagagactaagttagactcgtggataaggagtggagatgccaactgagggaggtgtaagtagagagtttgagtgacgtcagagaatgagtggtgcttctgagagggttatgttgggcttttcagttgatgtatgagtcgatatggttcctattatcagtgtaacgaagtcgccgcagttcaatacagtagtctcaaaccccactgtctagtccaagtatgtacttatagttatgttaactggactgggaggcttcttgtacactgcactcttgtgctgccaagtgtctgattttggaagagaggaagacaggtttatcgtgggagagcggtagacgaagcaaggatcaaagaagctgattgggtcataaagacttatggagatgttggtagcatatcctgacaacaattgtccgcttatgccacccccaacacctataaatactacctatagtctcgccataaccgtattctcaatgtcacgctttcgacatatcgacggttgctgtttgaaaaacatggggtaaaagaaagacattgaaaaggaacaagggaagaagaagaaattaagtgatcaagactcattcggttggtgattaataatagcaccaacaagactactccgtacaattttgccatcatcttcgatattacattgcagcctcggttgatcttgaacttactcgagggaacttctcagaacgaacctcttctatttccttcaattgattacattttcttacgtaagaatacgaatataaaaggcattgatttgctattcggttcatctataaagcgtccaccagctatccctgtttcttccaaaaaccccaagcccctgtatcctcaactaacttcttgtgtagatctgataaacacgccctgaagagggaggtattagacctcaccaggatatacaaacacgaaggcacacgggttttgaaagcatactccaccaatcatgacttttaaaatctccctataactctcgtgggtctgcgcgtgtgcgccacaccccagatacttcaccccttcatgcttactcatccgcctggagacgaacccaaaaggctcacaacctaaaattccgaacttctttcaatttatcggaccattgtctgcaaccactacaacacaactctacaccatgtttcgaaccgtgcgaagctgtgctgtggccctgcccacccgagcatccaccctgcgagcctaccattctatcaacctcatcaacacaaagcccaccgaggactacaatcccaagaccaaaaagttgctagacgcagccatggatctggtccccagtcttggattcactgaccaggcccttacactcgcctctagacgtcttggttacacagatacaactcccctggtgcttcccgagggtcctctagatctaattgtgtaccatcttcgacgagaacgagagaagctggccgtcgcctctgagactgctcctgccgaccctcctgccgcccccacgaccccggatttccgaaccaaggaccagcgacttgacgatgcctgccacgaactcattgtgcagcgtctcaagggcaacatccccgtcattgagcacctcgacaacgccttggcccttatggtccagcctcagaacatggccgagtctctcagcgagctgggagctctcagtgacgagattgttcaccaggctggccaccgatcgtccgactttgactggtacacgcgacgagcatccatctctgctgtctacgctgcgtctgaggtatacatgtgccaggacaagagcaagaactttgaggacacctggaagtttgtcaagagcagtctggaggcccgacgggggctgcaggagggcgttggaaacgtgggccagtgggtcagcttccagggcattgcctccgtcatggtcattcgatccctgatgactcggttgtaaggaatcacatcctacaccccgttttctgattgaaaccacatagctatagatgaattacgagtatatgagttgctgtacgtgtagatacttgtaatctgtggtgctcgtaaaattgggtttgcttgtttgagggaggtttggacctgttcagcactgattgataagatagagttctgactccgatttatcttttgcatcagagaggagtggaagtatcgaacagacatgtggtggttagagtgagtgatgaagatgtttaacgcagagtgtttggtgagcttcagtaaccttcggtaagcttggtgtatgacctttaagctagatggctgctgttactcataatctgtgtggataaggtggttgctttctagctataatgatctaaaaacatcgtacatactgtatgatatgatattgtagatactgtatactcgcagagatatttttgccaccttcggtgtttgatttttcttccccgatacgccaagtgtccataaatacacccttgtctgtgcgtatctcgccctccaaatgcgcagcactcagcgtgcagaggcagtacaagtacgtaaaactcagttgggaaaaaagctgtgattaagtgtctgtattgtggaggttttgagggacagatttgagatctaagcagaccggcttgttacttgagtcgtttcaatggaattggcgccacttttgtgtctttgtgggttacgaatagatcttgtagccgtatcctcatgggttttttttaggtctagacactacagtagaacgcgtagttgtgatatggcgatgactttaaatacttgttgtcgtacgagtacagtaagtacccgtgcttgtttatagtgtgtttttgctcatatttccttctgtttttctaccttggggggtctctgtctgttccaccaaccaccgtcgatccatatgaaaatgaacgtctctttttcgctctcttgggcgtctctgtgtgatgttgtcctgtcacaactgtcgtgcttttcagacgtgagatgcacagcctcgtgtatgaacaactggtatggacagcgcatcattggggagacgagaggacggttaagtcgaaataatccccaattttactctttttttgaccgttttttccccatttttttgccgatcgcctacctcctaaaaattcactttttgctctttccgccccaaattctttttgagacgtgtaaaattatggtcagccgtgtgtctcgaagttacgtggtgatatgcaggatggtgttgagaaacgtcatccgctgtaacagtggaggagcggagggaaaaatatcaattccaaaacgcttgcaattcgatacaaaagtggggcctcatctatttaccctccagtacactacgcgtggtcatctgattacaactatcggtattagtacgagtacaacgccaacccaacacacacaaatcaatttatacaccccctaaccctaaaacctaagccaaataattatcccttgattcgaagcgtgtctaatattaagataaaagagaaaccgttttcttccactacgcaacactcactctctcactctcagaatagcgacttctagcggcgtgtaaacgacaccaaaactgccacagccctctcattcccagtcgccaaaaaaaatccaaaaatgttttccctctcgttcaccaccctcacactcgctattctggtggttctgtgggcgtcgtcagcctttggagccaacgcagactccattctcgatacttctcacgtgagcaaccactgggtgtggtccttcaccgaggattccatcgctctgagcgcagccattgctctggtgttcacctattctgtcatcaaggttaccaacaaggtcgtgttggagccctccagcaagttcattgtgaccaccttccccgagtacatcaagctgacccaggacagtactcagaggtgattactgggtgctgaccgtgtgttttcttgtttgattttgattgtttgctgaaaggggtctgtacctgcaagacccagctccagccgaaaaggagccttacacaagacccagctccacagctatccagctgaaatgtatagattgtaatttattgtttgttattgaggtagtggagatgaaaagcgatgtcgtgattcacgtgaaacaagcctggaatatgcaggagaccccgtgagatcatcttgttcgggttatgtttcaactgcagagaaatacatgttgacagacctcaaaggtgtacctatgtataccatggtccactgtggtttgtcttcattttgtatacagtctatactctgtgtccagtatagcctatattcaactcctcgagggagacttctgggtaaggagatgtctttgctggtcatctatcatatcagctaagctgttaccagacgtgttgtcgtggtggtacaagtacttgtacagataccagtagatattgcaccgactctagactgtctgaaataatcgtttcatttcgatgatatcttcaacatcagactctgacatcaaaaagtggtgtaagagtaaggaatatagctaggtgcagagatgcaattcattcaccttaccaaaggaagtcagctctggtggctcagttcaattacgtctcttcagacataacttctgcagtagctacttgtacagtagatttcatggtcctacagtctgtacaatacttgtatccacctcctgtacaagtatatgtagtcgaaaaccgagataaatcagaatatcatagcttaaaggagagatgattatatcatggttatctcacctgcattatgaggtcaaatttgtgttccgataccgacatatctccatactatactgtaggttcttgtagctcgttacagcaccttccactctcaccatagagttccatatcgcgttttaggttgaaggctgatttcgattccaacatctcatccacaacatctacacacatcaaaatgaccaacacgttggatgattcaatcggaagtatgcaaaactgtgtgtcgatcgtccgagatacgtcactgaaactacggtcgcgtgcccagacgcctgaggaaacagagcgaatcaaaaaggttctacagctgacgcgaaagtacgaggaggtgacccagagcgaggtgctggcagcccagcagcgccaggcggccgaaattgcgccccaggttcaggatctgattggcggagtcgaaaaacagatcagcagtttgcattccaaggagcggaagctcaaatcacagtctgagctgaataagagccgattggagcaatttcctatgacgcgaagagaagtggttgacgtgccccgtgacgctgacaatgttgtggaggtcacggaggaggaactgcaagaacttgaggagctgcagcgagaacgggagaagctgaagatggagattagtcgtctgaatctggaaaagcggaagagtgtctatggaaagttgcctcagtaggatatataggcgtacgtatttattttaatttatttacccatgttgagggtgctattgcttgccatttgtgaccagactgtgacttggtaggtggctctaggagctatgttgcatcgtgaggcttaaggcacgcttgtgtcattatcactgtaacctggtgtatgccacggtggcatgcatttacagtagtttatagcacaggttatcagatgccagtaaatcatctgaatcatgtcttccatccagttctggcagctataatttaccccctattgcaaaatcaaaactctttaggtatgtacatacggcctaagcctgagcctccttctcgactctcttataattaacgtccaggtagcttgccagggagtaggcgtaatcgtggaccacctcctcatacttgacgggaggaccctgttcgtgcacattggtcaccttcttttcgtccagaccacatggcacaatgtggtcgaaccaggacaggttgttgttgacattgagacagattccgtggctagtgatgtttcgtcggatgtttacacccacagcggcaatcttggactctccatccatggtccaaactccagtgttttcagttcgggtggtgaagatttggtactgggcaagagcactgatgatactgctctccagcagactgatgtagcacttggggctcagggccgagtcagagccgtcatcgttaatctttcggaattgcagtaaatccagaatggggtatgcgacaatctgacccggcccatgaaaggtggtttctccgcctcgcagggtgtgtgcgatatcggccttggaaacatcaattggttcatcggacggctcggatttcgtctctcggtggttgggggtttccagaagggcgtcttctttgccctgccgtcgacccatagtgtacacgggctgcatctggaaggtcagaagcaccgggtccggcgtctccttgccttccttcttgcagtccagaaacttgcgcacaagcttgtcgtggatgccctgtgcatcagaatacttgatggggccctggatgtgcaggtggttgagtgtcagcggtcgcaccggtcgagctcgggtccagatcattgtttcttgcctaaacagacgtggaatttgtcgaaagcgcacggaagcacccaaacttaattctgtgtggaaatatgccggcatttcatggaataaatcttgaataaacaaaataactcgaataaaacgggacgatgaataaattgtgtctcatttgttattctgattttttgcaatcaaaatatactccttaggagcttcacgcatttgctagtgtcaaacagagtgagagcctatacactacttgaaataacagtcgagaatgttgaatgtgtcgcaggcacaagtaagcatagacgttcatcagtgagtcagaatctcttagaatagaccttgtactgctattcggactgtgttagattgcctcttttgtatgatttgggcaaatgatgatgtcctggtcactactgtattcataaatcaaacacccgaagcccgttggcgtatcggagcccatcatgcactgatagcttttatccgaggttgcgcgtgagtctatatctgtggatttgaggtcgtttcgaaggtggcgactttctagaagagcttgtgagtcggtttccgaagtcgttattgaagctgaaaccccgagtgttgtgtggatgatacctgtgtttcgagtgaataactgctggagtattgagctggagactggtatacaaatgggtatgaaattatcactgaaatacatattatctgctactggtagactgtcaactcagctactgcacaactatcggtacttcctgtactcgtacaagtacataatgtactgtaacgacttgttttctgttgctaacgtcttctcttctccagaccctgaattcaggcttatcagatcagaaatacatgtccgtattgaagttcagtatcttggaaatccagtctttaatggagacactcaataaacaataaagagtcggatttgtcattctaattaaaactcaacgaaatctctctcaaccccgcagagtccctcacctcttagaatttgtctcaccatcaaggaacgtctcgtctcgttgatgacttgtctgactctggctcgacaaatctgagtctggataggatttctggttacccaaaagcaataatgaggcgtgtttaatgcgtccccggactcgttgtcggcttttgctcttttggaccatcttatcaacctgccccatgtgctattgtagtctgtttgtttagttagtagctgtaagtagttacagtaggagcactttctctgcacagcaatgtagtttatagcgcacagtagcttgagtgttttagcacaacgtagataaaatcactcaagcggtctgtcaatggccggttcacgtcctcgtcagctgtctggagctacacagccactttcgggcacacccggtgacccataaaacaaaaattgtacgtttccacagccgcactatccgagtaatgtacctgcttccggtgcttcatttgaggagggtgagatgagagcataaactgagggttaagtggagtctaaccattagaggtgtggtgaaaatggatcacgaggcacaaaaagctgcacaaaacacaatttacgagattaatgctgatgcttcgtgtaaatgtgttttggcgagaccccaagaattttattatatgccgtttttccgatctcaccccataatggagacacaatgcttgtacttagtacttgtagctttgtttgttgaggggtatgtaccgactgtatgcacactgcatttggcagtcataacagagaagagaacagcacaccacattttgttcatagagctctcagatttattcagaaaaagctctctcacaatttactcatctccaaaagataagtgagtcgaaaaaagtccgaaaatcgttgagtttccgccctcggaggcaaaagtatgattgtgggggcggagattcttgatccaatggtgtgatttgacgctggtgataacggcgcacacatatgatagctcagattagatgacaggtattaggctagcgacaaccggatacaatttggaggaggtaaaactgaagtatcagcaaccaaagtgacggaaataccacttataacactactactaggactactggtagtactacaagcagtacggaaccatgtgttcgcaaccatatcctagtgtcccgcgaagctcaaagtctattttctgtagtttgtcagagccaaacacagtagactctggatacttaatctcacctataggccctctgatcatggcgcaaaaaagcaacaaaacagaggacgctcccatgagtgttgaaacacagacacagacgcagcagcatgctcacgtcggccccgcccagatggcatcggcctccgcagcttcctctgtacacatcaaggagctcacccaggaggtgtcttccttgtccacccggcttctccaagcgatggaaacacagtctgagctggaggaggagcttggacgagagaagcgtgacaaggatcgagccaacgtggagaacaaggagctgaaaactgaggtccagaacctgcgggaggagatgcaggagctttcagcggagctgtttgatgaggccaacaacatggtgtctgacgctcgaagagacgccgccaaggaagtggcagaaaccaagaagcgcaacgaccagctcaaggtgcagcttgaggagcgagacaacttgctcgagagtctacaggcccagctgagtgcactaaagcaggccatgcaggagcgagacgaggaggaagatcgactacagaacctgggcgaggagagcgatgaggaggagcaggaggaccgtgttacacaaagagacagcattcacggaaccacgaatgacggatcagacgatgggtttgagtctgccgcagagggtgattctgacaacaaacaacactcgtcgttacccggatcagcaaacgcttcttccaccaacgtttctggacccccaccagttgctactcgacctcgtctctcccgtgctccttcatctcgaaagcgaatgactgccgcacctaccacagcagaactcaactctccctccaggcctcatcttcgacaggatctggcctcttttagagacttcattgctctggttcgacaggctgctaagcagcgagaagcttctcttgagtctgccactaactcggcctcaactcatgcggccggtcccacgtcgtcttccacttcttctacggacgtcgctgccacttcctccaacgatgacgtaccccatactccacccacacaccagggccccttcaagcacgacgaccagtccccgctcacatccatctactcgtcgtacatgtcaccacaatctcacaaagagcccccacaactgcaactcaaggatacgcggtttttcaaaaaattcatttccgaagactttgagcccactctgcgacttgacctggcacccggtctatcgtggcttgcccgacgagcagtccagatggctattttggaaggaactattgtcatcgacccaatcgcagctgtcaacgagctgtacggtgtcaacatgatgaccaacatgtggctgaatggaggattcagcgagtctgctggagctccccgagatgccaacggagagcttctgaaggacgcacactccggagacgctaccacctctaaggacgtggttgctcccgatcacccccccaagcaacgacctgtcagtgcattggtcagctttgctcgtgatgccaagctgatgaaacccgaaaaggtgaacgaggaggataatcacatcacgcctcccatgtcgcgagaagaagcacgggctcagactgcccgagatctggaatcaagggcctcccacgattcgtcccgacactcgcatgactctcgaacgtcttcctccaacaacgtgtcgcctcccatggcgactatttcggcctgtgctctctgtggcgagtctcgaaaccactctctggtctatgcccgtcttcactatctgcgaacagctcatgccgccgctggagagactggcgagtcaggtgaagctggtcccaacacctctgccttgactgcaggcaagggctaccctctgtgtggttactgtctggtgcgagtgcgagctgtttgtgactacctgacttttttgcggtctgtcaaggacggtgtttggaaggtggatggcgttgcctctgaaaacaaggtgtgggccgagtgtatccgactcaaggagcgaatgttctgggctcgagtcggtggaggtttcctgtagtgtgtgtgagagagatagggagagagagggagagagagggagagagagggagagagagaggattccaggagcataacatcaggagttaggtgcgtcaggagcattttaatgataaatggcccgtccgaagagcacatgcaagaaagtggtgtgcaacgagaacatggccggtaatgagttcacgtctggagtatactgtacaagtatgcatgtacagtgtcagtacagtaatacaatgattaaatgatagaagcaatgaagtggaacacgtacagcagaagcccgtaatattatttcttgaaacattccattgtactacttgtagtacgatacttgtagtctgacataatgtcttggcgttctaagggccgtcttgattagtcagatgaacaatgtagtattacagtagtaagtgacattgatgagaaggtgatgcagttgattgatacgcaacagtattatgggctattggattctcttatttcctatgcatgccacgtcctagctacaatataatgtctctcataagcaacagtaaagtacatagtgtacgtatccgtacgtagaaggatccctgaagtatctctcaaaaaagacagtcaagtaagaacttagatctaagttaaggagattttattttgccctagaataaaagtctgaattgttgattaaaaggtgttagtacaaatactatggcctcccgacaaaggagatatcactcgaacaagtgtaaatactccgctcccatgtaattcctaatctgcttgcacttttacatgatccttaatgacctcttcctgcacttggtcctgcacacctcaaactttactccgaagatgcaactcgcactttgtttccaatcgtgactccaaaaacagagacatcactaaaccacaccgccgaagacgacaataccatgccgcctcgacgatcaggacgaaacaagaagaaggacgaggatgtgacgatggcttctgccgacacggatgtcaagcaggaagtgccatcttctcaggaccaggaggagaccaaggatcaaccaaacaaaccgaagcgtggaaaaaagcgaggagctactgaggtgtccaaggaggatcaggttaaaacggaggctggtacagatgaaacagctgatgtcaagcaggaaaccacagagacttctaacgaaacacaagcaccagttcaagagactgcagaaacgacggtggaatctgaacagactgccgacgaggcatctgtagtggcccaggtggaggaaaagcttgaacggatcaacgacaagaatgacaagctcagcgaaaagagagtatccgacaaagtgctggatcagacgaaaatcaccctgcgactgctgatgagcagacacgccacagacaaggtggataagacggtcaagaagactgtggaggatgcaggaatgacgattgaggtggtggatacggtgaatgcgccggaaaacgtgattcttctacaaggaccgtgtaccggtttggatacttgcatcaaggctctattggacctcgacacagccctagctcctcctggaatgatcacacgacggcttagactgctgtttgaggatcaggtgttatcagagattccacagatcaacatcgccacaaaccagaacctgtttgcatctcgacctattgatattgtcacaggtgtccatgtgagcgtaggcatctctacccttcctcagagcactgacagaagcgtggttgtttcaggacatgcgaatgcagtcatcaaggctgttcgtgagtttctcaaaatgattctgtttatccaaatggacgggttgaaggctaatggaaacaacacagatgctgccaattacgagatcgactcctccacagctatttcagctccatacatctctaagctggtcactggcgtgtacggtcaccctgacacgtttgtcagacagaaggagaatgaaaagtacgttggaagcaatacatacattactcgaagacgtcgggtggagattccggatatcgatctccgaaacgttcccaagggacccgccgcctctgcttcgacatacaccaacaacggaaacagcaatagccacggatataacaaccacggaggacacaactacaataaccatcgagaaggtgcaggataccacaacagcggtggacctcgagatggacctcgagatggaccccgagatggaccccgagatggaccccgagacggacctagggatggacctagggatggaccacgtgacggaccacgtgacggaccacgtgatttcaagcctcctactggtcctcgaggtcgagggggtgatcgccctgttcgccaggatgccagaggtcctgagattcgcgagttttcacctcgagaagcctcaggacagaccactcaacagatcaacgtacgaaaggatatgattggagctattattggcaaggggggatcctctatttcggaaatcaggaagaagtccggcaccaacattcgtgtgattgactcggaggaccccagtcagttggaacggtcagtcagtatcactggaactgccgatggagtcaaaattgctgtccggctaatccatcagaagattgagcaggaaaaacacatgtatcgaagaagttagaaggggtaggacaaacggcatatagttattgtatatcagcattattgagtatcaatgaagtaagtattcactcaaataaagtctaagtaaaaatatgacaaaatgcactacaccaaccctagcccacacactcgcatcagaccaagctgcaggtcactccactcattacaacacccttagaacatgtttggcatcttttcgcgcattcccgtggagctgcgcacggccgtgtcgattgcggttcgagcaggctgtgccatccatttctttcgcatgcacattttcgagtcttcactcacatacggcccatcaatgattccgactcttgatgagaagggcgactttgtcaatatcgacaagctgaagagcagagggcgaggcgtgcaagttggtgacgtggtcgtggcgataaagccgaccacttcagaccagcgggtctgcaagcgaatcagtggtatgcctggagacatcattcttatagatcatgaacggtctgataacgagttcattcaggtccccaagggtcactgctgggtcactggcgacaatctgagcatgagtctggactctcgaacatacagagccatgcctctagccctcgtcaagggtaaaatcatcgctgctcactcatttgcacggggattccgattcctaccaaacactctggaggacgctgcggaagatgaactaatcacaaatactgtgacattggtggaggacgagcctgttgaggtggccactacgagcagttagtggtggattggcattgtacataagtactataagttattagcatggttggattgtactacaagtacgagtgaatacaagtagagtacatacataccgccataaaatgcaccaaaaaaagcgaaccacaatttgtacgaccgtagccatacagtacagtatgtacaggcatgtgcttcttatctctactattgttactcatgatctaataaatataaaaagtgccgcttgagacgacgttagtgaaccgtggctatcttgagagccatctcaacatgctctattcggaatcggggcagctctccgagattgacaccgtgtagagtcaactggtccatcagaatagactcgtcgatcctggctccttgcgccttggccttgaggtactcattctccacagcaactgggcccatgtacccagggaagttagagtcttcatccaccttacctgaccagtaagaccccgacacggaaatgggaagtttgagacatgtgatgactcgcgggatagagaagtcttcgtggaaaccatgagcgtagaatctgtgaagcttctccttgttgccctgaatgtacgccgttagcacttcgaacagtgctcgtctgaagatacgttcgcacagtcggtccaaaatcacggggaactgcaatgtgtgaatattgtccaatacgtcctgcccagactccatcagatgttttcgctgggtcaaaatgacctctcctaccttcgcaggggttgctgccgagtccagagatgcgtacggtttggaatcatggggatagccaggggtgtctgacttggggaacgtgtttttgaccacctcatcgggggtcagagagaagggagcaagaatgtcggcggtgggcttgggaatgtcgtgagaggaagaatcgggggtcagagacaggtggctggacatgtcgagatcggagtttggcgagtgattctgatgctgaatctcgagcagctgctctgcctcgtttcgcttgatccactccacaatctcgtgaggaaggtctttgattatgttctgtgcgtagggcatcatcgactcgtcatctgtacgagaagacactggggaagagcccattgtgtggttctggaacgtgctgacggggttagacacgtagtcgttgtacttgagtaccatgtcggctgttaacttgtggctggggtcggtgttattggtcattcgcacaaacccaccgattcgaatgccagcaaacgcaaacagctgcatcagctcatcattgctttcacgcactgccacctggactcctcgctggtagaactcgaagaaggacgactctacacacgaaatgaccttttctagagcctctacacgggcagtgagctcatgcacaatgttgtcacgtctctgacggtactgtctctgagcgtctctcacctgagctcgtcgtcgctgtgttagttatgtgtcatgaaatcgcaaatatactgcaactagtgaacattcgaactgatgcatattgtgttttgccacaagagattacccctctcggacaaatctcggatactgctgtatcgcaacacaggagtgggaggaaatataatcacaatccaccatgaaggacacgagaaacatgatgcactccgtatgctagatatcacgtcgatagttgcaatttgctcgtttgggcatgacgttttactcacctcagcttgagctgcagaagaagtctgtagacgaggccggcctctcttgttcttcttcttgggaggctcttccactgggtttaccgggttagcgatcgcagtcgacgactgttgtgacagctcgacgttggtcatggtgatcaaagatgaagggcactgtacttgatgtgtgcgtgtgtgtgtgtgtgtgtgtgtgtgtgtgtgtgtgtcactgtagatgtgtgatccagtggttgtgttgagtgttcaagtcgtgaggggcgcagtatggtgcctttatgaactcaagatatcaggcgtctgtgatctgggggaagtatcgtggtgtctttaccgccatatatatctatctgtctttttctctgtgctggtttctgtctcgcacttcctagctgcattttcacactccttcacactctaaactgccaaatagggttacgcggggtccaccactttagtgtgtcaactattaacgcagcagattatgcatgcaggcacggccgagaggtgaaggaatatggaaatgcacctgaaatccatgacagagaacggtaccacatagcagctcaatgcaagaccggaaaaaacatctcacccactcagttcggagacgcggacgcaggaccgccgctgactcgttaagcttcaataccccgcattaattttgcctcttttctgccatatctctttgttgcgacatgtaccaacggaccttcaccatgcagcaactagtgaactagagctgggagtgtagtgccaccaccggcttgtgattgttgacaatctccgggtttgcgtgcgtttgacaagcccgttccccacctacttcggggctctctcacagagtcgtttcagtgttcgtatccctcgagagcaattgttttacgtggttccattactgtattctttcattgtggttggagcgtcacttttctgttgagtaatcataaaatccacctcaggtaccatacgcacagttctaatacggaccgtacacacaagtgaccgtccgaaagccgcaaatgaacaatagcaacctcaaaaagcatacgccgccacacacacaataaacaggtacaagtgcaaatgtccggttcaacgcacggtgccttctctcaagccccatggggaaagatctatggccgaagccttgggtccgaaaaacaaaaaaccgagggcaaaaagaaaccttgagtgcatctcaaatgcccgttcggagctctaaagctggggaaatacggctatggacgacgttacgttgatctagcaagcccagcgtagccaccgacgccccgctgttttcgtttaggacttggagctaatgtccgcttgatacagcacgagtacaataacaagtggaacgggaacagatttggtatcttccgttccgtgtagaggtagtgatggtggtgggggagttctgttacaagtactaagagtatttgtatcgtacttaccagcactacatgctgcagagtgcacttcagttatacctatagatgatacccatcgaagctcacgtatagtattatgtaagggccacaagtacaagtacaagtatatacacaagtgcaagtacttgaacgatactgtctattgtatcgtacatggctcaattgaggcattgaagcaggggctggcgatcttcgccaccgcaacctcgcacaagatacaatacagcctccttgtgttatctttatcacatggatcatttacatttgaggttcctcttcgtattgacccctccttgtcttgggtccttttaccccaactacacaatattttgcaccttgttccgtctcccaacgctcaacaggccgatcccggatcaattcaactgaagcggacaaatgcactggttggacacattggcacactggcggcatgtcaggggcacactactctctagacgcaaaatgacattggcacaagtcaagtccactttcacattgtttctgccactaccaaacccgtcactcaagctccgattgacttccctccacccccaaacaacccaagtccagcgcgtgtctaccccacatgcagggtgctatgcatgtgatattgtggggtaaaatcatagtagacacagtgtgaatagaacgtcttgggtaagggtgaggcggccgaaccaaaggggagtaagccgctcttctgagaccccatcgacgggcgtgctcaatgtctcggtctggtatgctgatcagagccgaggctcgcttgatttcgttcgatttttatttctcgaactcctgaatgggcaattatagacgcgcttaagtgtcagggacagcttgtacattgctttggagtctctaaaacctgcattttgataatctgtcaaaagaccaacaagaaaaattagccgatccaggagactctgatatcttcgagcggcatttgcacaggcattgaggtacttcctaaccctcgttttagcagatcgagctggaacactatgtggcctgcaagtactcgtagctactgtagcttgaagacgaataggagttcgggaaagtcgcttaaaagcgaaagatgaaacactatgagctgtaagaggtataataagcgagctctaaattctcattggtatttccaggagactaatactacttgtagggaggcacatgtacagtaagccgaacatttccgtaaaagtagatcaatgtcaacgcctccaatagttactgtacactcaacgtgtcaagaaccaataacctgattgacctcgcttgcgaaaaatcagaaccgttgagaagtcgcaaatcaggtaacggagcagctataaaattgtgaacctgtacatcctgtacacttttttacgagcattgatacttactcgtacgtctcatattaactagaggttatgtctatagatcacccgcataggcagttaaaggtgtgtgtaatggagatatataatttcacaatactctacaagtaccggaactatactcgtgcatgtatctcctaattccagtagacttcagctttctcatttcaaacgtttcttccgttatttatacatgtagccagcccatgatcgaatcttggaggtgtacactagttcctgattgtgccatactctgtctgaatacgaatatggtctactgagtgcgtgctgtagcctgtatctacttgcacattatattatccattaccaaaccatctaaggtgtatatacattaaatacgtatggagaccaccatgatcccttcaccactgatcacacttcgacgcagttgttaagccgtcgcttctaatttctagcatgagaacagtatcaagtctgaacgcattcacacgaccaagtttatgcggggaccttcatcgaatgatcgaatacggcgttctcgtcagtcacttgcactaccgctccgcactgtgcggtgaccaaccactcgcacctatcgtcttccagtctcacgcagcttttgcttgattcgagcatattcctttcgaatcgtcacgtagtttagatgcatttttccgaggaaatggtcagccagacgccggtcagtgtccagacgcgacaagtaagcgccacaagggggacacacttggagtttttggtgacccgagaaacccgcaacagtcatcattttcgccaattcgcgctctcgtagcgctcgttccgctcgtttcgagtccagctgctgcatttcagccaaggctcgcgagatctcgcccagctctccaagcagtttgatttcctccacactcatagcaatagacccatctagagcctccagtttttctgtgagttcccgaatctggttgacttcgtcgtgggtcgcctccagtttcagctgtccctcttcgattcttcgatcacactccaccacgtattttgccagttctcgctcgtactccttttccagaggtgtgagatttcgaccctgctccacaagcagctcgtattccattcggtgttgctccagatgcagcttgttgcacgacgccttctcaaaccgcatgcccacaaacagatcatgaggacagagaccgacggtgaaggagtggcacaccttggggtcgtatagatcaatcttttgacgggtgggaatcgactcgagagcctcagttcccatgagctgttccagtagcttcctttgttccgcggccatttctatgctgtgtgatgctgtgtgatttgttgattgtaaaagaggaatgtactacatatggtgatacttggtggtggatcttttgcagatgcagaaacccaaagttagatagttcaaacagtcgaaggattgtaccatgcattctagagagtaagtgaaacgaaatgtatggatacaaagggggaccttatccttgtagaaatttgctggaaacctactgaataaaaaatttgagagcagataaactgctcaagctcaggatttctaacacctcaggcatccatttacatgtactgtcttcattttttttgccactgtctgaagacgtctaattagtggaaactgtgttttgaggggttgagacgggaagagcttacagtacagtaattagtgagcttcatccgattaagtacaagtacaatatttccctcaacttctgcatgggcaaatatattactcaaagccccgcctggaacgactcgtaccgactacagtacctctccttgtctatgtcataacgtacactcataccatatgatgcaatacacgcaagtaatctcatgtgcacctaccgtcgccagacaaaccctaaccctacacatgtccaatgaattttggattcaatattttttgaagccagcaactgttatcttcttctcctcacaacccaacacactaaactccgacaaaacgacgtgctactgtactctcagaagcatcttcattttcgcattaacaacacaaacacaggtaaagtattaacacagattctttcccgcttctaaacatgaaccacaagtgtgagtataaccgtggcaactgtcatgtcacaaaacacgtcactaatacagacacacccgtgaactcgcgcttatctctggctcgcccaccagtgcagcctccgccacctcctcctacgtctgggtcggcgtccgactggcctgaaggactcaaacagtttgccgctgcgtgttttgcacgatgtcctagcggccctgacaagcctatcatggaggctcagttgcgtaaggtgatcaccgaggcgtataacaccaatactgcatattcgatcgattggagtaaaatggtgctccccgttttcctgcccaccaacaacggctacacgaatagtaacaacaatggtcacatgaacaacaacggctacaaccacaacctcaacaccaacaataagaaacgacctgcatttgacactaacaagaaacagttcaactccacgatgcccccaaagaagacgaagaccaacagcaagcatggggagggctatgtggagaacatcggaagcatatcgcggaaagaccgacagatgcgtttcatgcgcgagcaacaagcggtagtcggcaacgctaacgcgtccccagcccccgaagtgaccaccgaccagcctcttgtaggacgaagtactgccctggagaagaagtacctgcggctgacctccgcccctaatcccgatactgttcggcccgtggacgtgctggaacgcaccctggagctgctgatgaccaagtggaagcaggaccagaactacgcatacatctgtgaccagtttaagtcgatgcggcaagacctaacggtgcagcgtattcgaacgacattcacggtcaaggtatacgaaattcacgcccgtatcgcgttggaaaagagcgacctgggcgagtacaaccagtgtcaggcgcaacttaagacgctgtacgaagagggcctgcccggcaaccggctggagtttcttgcctaccggctgctgtacttgctgcacacacagaacaagcaagaggttggcgacattttggttgagctgctggacgacgaagaggcagcaaactacgagcctgtgcagcacgcgctgcaggtgaagacagccatgatgactcgcaactatgtagagctgtttcagctgtatcgaacggctcccctgatgagtggctacgtgatggacagctttgtggggcgagaacgtattttggctctttgtaaactgacgcggtcttttagaccgactattcctttagaaacgatttccgagtggctgggatttgagtcggagggcgagtgcaccgagtggttggaggggctgggcgtggcgcagttcatgggtcccaagggtctgagctctaaagagacttatcctgtggttgagggacatcgacagcaagcctttatgaaaatcgacatcaagggacagatttagacacggcacaaggaacaccgcaacggaagaagagcacgattccctccttggctactagctctcgtagtctttagcagtattagatagatgccagatgagaattatcgaatgttttgcgtatctgctatcgtaaccatattgtacctgcatctctagtatgtaaacttggcatgagataatatgagctattataatagagatgaggcagacaggttgagtctacatggagtacaatagtttgaggtccttatgttacagtagctcatagtaccacaagtacgatagctgaagtattgcacgatccctgtctacaatgagatgtggctgatgagcccttttcggctgttgcgcacacctagctataatttcgatgttatctggcagaagtttgaatactaaaatagtcagcgcacgccaaataacgattgcacttgccacattggccagggctgaagccccatattgtgcccctttgaatctcagccacgtgtcttttgagtctccctgatagctatttcttcgaggttgggcaacctcaaagcctaccgatgataagtcttcggggcttggagctgcgttgctattagtcagagataggtgggaagatatcagagggccataaagatggacttgtgccatccgaagcgtttggttacataacgcatataaaatccgaagtgccataagtagaaatgcttcgacttgtcccacctgtcatccctatcgttcctgtgtgtctaagataccaggtgtggaagtgttaactcgcatggaagagacctgtgcatgaatggggcatctggatgagaaacgcggggcaagtgtaagttaaaaagtgagtcagtggacttccaacatttggagctcatgtgggtgtgtagggcaagagtagagaattatgtataacctctattatcaaccgccggctgtagccttgtaaccaccccctggttgctgtcccaacaaagccctcgcttttagctactagcacatggattctgtcacggggtttgccacactgatgcactgtcagtataaactatcaatcttgtagcaagtcccaaccctcagcgcccctaccatcgacatccctacaagcgtttgaagcgaccgagaaacgggtgactattgctctcaagtcacatttgcccttcagctctcacaacatcaccatgacagacacagacgagtcgtcgcaattcgacgaagagtcttacccctcggacgggtctctggactacgacagcgaggaccaggacatggaagactcgcagttttgggaagaagatgaggaaatggagccctcaagcgacaactttggcgccatgtctcacagcgaggccatccaagtcgaccacacggctctggctgccagcagtcaacgggtgctggaacccgaagatctcctcaagggccaggcagccgacgtggcacgtgtttcggaactcacggctctggaaccgtggcgagcagagctgctgctatggaaagatgactggaaggtggaccatgtgatcacaaagtacctggagcaaggcgaaaaggtgctgcgagaagctggcatgttaagtgacgatcctgtggagtttgtcatttctaagcctaggcccgatttcatgtgctttctgtgctgcgacgaagacaaggctacgtcattcaagctggcttgtggtcacgaatgttgcactgaatgctactctcattacctgcgtggaaagattcaggaaaacggctcgctggatatcacctgtcccatgaactgcaaagagattgtacccaagcctgccgtcatgcttctgactgacaaaaagctgcaagccaagtatcaatccactctgtgcacccggtatgttcgtgcccacaatgacatgaaatggtgtcccgcgccagactgtggcaaggccgtcaaggccaacatctccgtcacagatgaatccgtcatccccattgcagagtgcaactgtcaccaacaattttgtcttgcctgcaatattgacgaagaccatctaccatgtccttgtaaggttgcagctcgatggctcgaaaagctgcgggatgagtctgaaaccatgacgtggatgtctgtcaacacaaagccctgtcccaagtgcactaatcccattgagaagaatggaggatgcaaccacatcaactgtactcagtgtggcaaccacttttgctgggtgtgtttaggagactgggccaaacatggctcctcaaactatcagtgcaacatgtactctcccgagcaggccgaggaggatcagaagagcgtcaatgctaagcgagaacagcttgacagatatatgttcttttacacgcggtacaacaatcatcgagacagtgccaagctggacgaaaagacgtacaagaacattactaagacaatggagacgctgcagaaggaaggcaaaatgacatggctggagtcgcggttcctgccatcgtcgttcgagattctcagacagtctcggcagacgttgctgtggacctatgcgtttgcatttttcttggacgcccagccggagcgggaaatcttcctcaagaaccaggaggatcttgagctgcacaccgaggggctgtcagagctgtttgagtacaagtgggacaggattccgggagccaaggtcaactttctggacaagtgctcgtacctcaagtcccgacgtcagaagcttgtcgagcatgtcatgaagggtatggaggagcgcaactggaagtttttgaactgatcatgggattaagcattgagataactgcaaataggaatagcatatttattattatctgcactgaacgaggatgaatggaccgttcagttttcgtaatgtgaacaatttacttatagcgagctgaggaagaacggggcggttgtacgataccatcgtacaagcagtaaacatgtatctctagttgtagatattacagtacatactgtatgattaatcatgaagaaagtaaaagtagccactgctgcgtactacaaggtattgtacgcatgtacagtatgtacatagtgtacaagtgtaagtacagtatgtacaggatgtacctatagaataccgactgtgacaagaacttattgccattaaataatacattccatctatacaatcttagttctagtcctttacttgaaccgcttcttttcgaccaaatagtctcctcccttctcctgccactcctgtttgctgacccacagctgatggaacgatcccaggctgcccaaaacagaaccgccaatccaagcaccgtgtcgtcgctcctcctggttggaagcagcagcaactcggaccttaagaccactcagggcctgggtcacgtccttactgactctatcactgagaccctgaaccagcgaccctccaccagtgataacaatgttgttagccaggtgagccctcacatccacgttggaagcgttgattgtgtccaccaccatctcactgagtccccgcgcagtatctggcacagtctctccgtcaaaagggtactcactgggcttgaataagctctcagaagtagacagacggtctgctccgaaagttgtgctgtagcccgtggggaactcgaagacccggtcggcggcttcaccagagatttctggagtcaggggaacatcgttcacctgacacatggagtccttgaactcagagagaatacgagacacctgcagatcagtgaaggaatgagtgacgttgggaagctcccgcttggtgaacacaggtggctcacccatctccacagccttcttgttcttaatctcgaaccgaggagtgagatcgattcctcgtgaaacaagcacctttttaatctgtctatccaaatagtctccagcgtactgtgaccgtcgcgcgggcttgtaaagcaccaatccatcaatgacaggtgtcacagaagccacttcagatcctacatccagtaccagtgcgtttccctttcctgcagcaaacgcagaagccacagcgtccttgaccaagtacgatgccgggacctcgaggctctcgaacgcgatttcaagcgccttgagcttgttggcctgcgtgttccagcacggctccgtcagcatcaatgggtgtgtctttgtgtcggcattgagtcgagccagcgagtattcccaaatattctgcaccgcgtcccaatcagccacaatcccgtcggtaagaggatgaagcacctccatgttgggcagtggcagattggcggagtcgccaaccttgtacttgtttaattttttggttgtgttgcttgtatcgtcctccatctcgacatcctcgtctgccatcagtccacactctgtggaaaccaccagtttgggggtatcttctccggcgtatccgactcgagtgtacgacgacccggtgtcgatcaccagggtcgccacctcatcgcctccatacacctggggggctggagctgttgtagtcatgatgggtggtgtgtcgtcttcagatggtagtatgtatggggtaccagtctgtacgtgatatttgatggtggagagtgtgactgatcgtgcgttcgagtttcgttaatgcacgaaaataacattggttagagttaattaagtcgaggccgaaacaaaaattaacatgagactcagtagcacgagactacagttcgaaacggcaacaaaaggagcaatttcaaaggcgaaagcgcgaatataatcttcgagaccggctgatcaaatatatttctcaaatccccacaatatcccgtcttgacagtgacaaaacattgtcctccatcccaggcacctagacaaacctcccaacagggtaagggcacctgcacccaatcaaaagccacccttgctattgctgttcctcaccacacaaggtctgtactgaacagaaaaaaacctcgaccaaacacacaatgatcagagctacagccatgcaccggtcaattgtgcagcgtcgcatgctgagcaccgcctctcggctccagcaggccgccaagcccgctaccggctccactgttggaacagccaatggcgcctctgctgcctcgggcaagcctcccggagccacctttgagggagcctccaagcagaagaagaagactcacaagttccgaaactttgtgctgctctccacctttgtcggcgccggcgcctttgccggaggtgtttattactcccttcagaacgaccagttccagagcctgtttgtcgagtacgtgcccgcggccgagcacgccatcaactacattgaggagcagcagctgcgatccggccgactcaagatcgcgactcccacctccaagcatgacgttgaccagtccaccgtccgagtgcccaagtccggtgctacctggcgagcggtcgactccaccgatgctgctacttctgccaagtctgcatcttctcccgctgccaacgtggccaaggacgtcgcttcccccgctcctgctgccaccgcctcccctgtctctagtggttcccccaagactgacaacaccaccgtgcccgctgtgcgactggctaacgactctgaccccgccgtcaaggccgccgtccagaccttcaatgatctgatcgccgtggccccctctggtgccgccaagcagctctccgccaaggtctccaccgtggtcgaccagctgcagcacaacgtggcccagatcaagtctgaggccgccgaggaagctaagaactccatcaacaagctcaacagcgagctggccaagctcaaggcttccaccggcgaggaaatctcgtctaaggtgtctgccgccgagcagcagctgcgaaacgagtttgccgctctgcgagcccactctgagaaggtctaccacgaccgtctccgagtcgagattgaggccaccaagtcccttgtttcttctcacgccaacaacctgattcaggccgtcgaggccgagcgacaaaagcagtacgcccaggagattgccgagcgagtcgaaaccgagcgagagggccgtctctccaagctcaaggacctccagacttccctcacccagctgcaggacctggctctcaagaccgagcaggccgttgacgcctccggccgaaccgcagctctgcatcttgccatcgctaagctcaccggtgctctcaagggttccgagcccgtggccctcggcccttacgtcgagtccatccgacgggctgctggtgacgatcctctgctgcaggccgctctggactctattcccgaggtcgctcagaccgagggagttcttacccctgcccagcttaccattcgattcaagctgctcgagcctgagctacgaaagtcctctctggttcctgttaacgccggtgtcgccggtcatctgggctccctcattttctcctctctgctgttcaagaagagcggagtgcccaagggagacgacgtcgagagtgtgcttgctcgagccaacattgctctggagcagggcaagctatacgacgccgtggctgaggtcaacactctcaagggatggccccgaaagctggcctctgactggctggacgagggtcgacgacgaaccgagattgagttcctcgccgacgtcattgccgaggagggcaagctgtacggagctctttctagcaagaagtagacggaagggaaaatatacaatagattttgattatgacggaaagagtgtatatattaagcgggtgggcagacatgaacatttggagagcttgtgcacatgcccgttgaatatgcgatgaaagctgacgcccgattggtatgtaggccggtcatagcagcgcagttctaatgaatgcatagcaactgatccagtggatgttcattacagatacaggtaatactgttgatgactttcaagagtccccatgattggctcctgctgaagaaagtcaacttgattgaacatcatgtatcgtaggagagcgatttcggctccagagacgagacactaaagaacgaaaagtgtcccagagtgtagtgcagaccgagaagattcaattcaagagtcaattccaataacctgatctgcccattggttcagtcgacgttacttttttcactctgatggcttctacataagataggttcggcgagattcgtttcgcgcgttgaaagcttgaggctattatgtcgatgatctcgagatatcttgtgagcgaagaaacatgctgtacagtaaatataaccctgagcaggttccctaaagtacaggtatcttaacagtgaactttttgaactactataaacgtactgtagtccgagatactgatacctttgatgtaaccattggtgatggatagggtaatttaatcaagtcgacatgaaacagtttcaatcggtacaactttccccctaaaaattgaaaccgacttgtccaaaaactacatgtactgaacttgcttctctgttgcttctctcaatatattcattgtgctgttcaaatggccatctgaagccaccatacaactactcatacataccattgttcttctgatagagaaccctatttatgataagttgtagccattgttttgatggtcccgaggtgtcccaaacagccactcaccagccgtgtgtatttcgatgcagggataaacactcgagaaaacagacaaaaattagaattgagaatcgctctcggtaccgaaatacctcatttaccgactagccgcagtctgaagttcgccacctttctaagacattcaccaagcttaaacggggcatagggcactgaacagaggcggggaagatggttagaggtcgctggtatgctacatgtactttctgggcgatattttcagcttgaaactgtttgctgacctaaataaccccaccaacgatctctattccacctcaaccactgccatccatctgcccagacatgtcgaaacctttggaagcttctgtagtgcatcaatcatgcatcagtatgcatacgaaaccctatgatcgggcatctccacacatatgacatcacatacaccatctctctcttggaagtacacaacccaacacaataccatttcagtccaccaaaaatgtcgtcgaaaacagcctatgaagattttcagagtgagccccaggatcccctgctctgtgacgcgctaaaaatgtcactcaccacggctcaggcctggactcaaatcggtggcatttcggctgcagatgatatcgccacacatgttctcgatggctctctggacgaggcgagtactctcaatctggccgcaacggtgtccaatggatactttttgctgcgacaatacatcacatcagctaccaaagcccctaaattggttaactgggccacaacaacatatcccgacactgacgaacgaggaaagatgatatgccgacgaatcctctttctgtgttcgtcggagcgtattgagggcttgaatgtcgccacccttgccaaaggcctggaactgggactcacagatctgcaggatcagctggagaagaagaaacaggacaagaacctgcttctacagcatctgagagaaatcctgtcgggatttgtctgtctcattacagtctacaagacagttcgagaggaccaggagaaacagacaagtgaaactctgaaacagattgtgcctcatgtgctcactctagccactcaaaacccagagcttctgtacccctgtatccccattatcagttgtcgtcctgatgtcgcagtggagtcgcagaagctgtttgtgacgtatctggagacgttggaggtgcaactcaagcaggttttgtgtgccacctatccagacatcactgccttggctcagctactctatggacttgctcctctggtccctatcgtcacaactgtcgatggcgcagaaccagccagagagatcctctgtagagttttcttgccatctgacgaagaccgaaaggaggccattggaaagaccaagagtattcccagccgacttctcaaggtgacagaggagcccgagttccaggactgcaagtttctggtcaacgaggcccaatgggtgctgtgtgaagagaacaaggacaagttcacagatgccattggcttcggctatgctgcgggttaccttactggattcgccgcctcttctgcctccactggacctgcatctaactctggttttggctatgataaagtcacaggacagaagctgacacctgaactgcaagagctgaagaagctacaggaacaaatcagcgcaatgagccctgaagagaaggaacgggaggccgaaaaactcatgtacctttttaaccgaatgaaggagttgggaattgtcaactttgatcatcccatgcgagctgcccaggagagtggtcgtttcgaggagctggattaatcaagttgtctgtgaacataatatattacctataacaatgactaattctactgtgcccacatcaaaaacttattactgcttattgtcgacataaagtacgagctataattgcctatatactatttgtgtatctgtacagttatcttctcaatcatgtattcgtattcattgactaatatgctaatgggtgtccttgtctttgaaagcgccaatctcgttgagatgctggaccagacgcttataatcgtggaacatggcgtccacgtcgcccagagtcagctctgtggaagaggtggctccaaccacattttgcagcggaggagcaatatggggcatcatcttgggcatgaactcggtttcggacgtgctggaaatgctagtgcctcgggcctctcggataggagagccggagttgggcgaccgtgtgctgtggtttggtgtggagcttctgaagttgcgaatgactccgcctagtcgtccagacagcgacgtgggctgctctgcgtcttcctctgtcgctaggtggtccatggagatcgatcggggcacgtttccggaggtcgagagacgtccggaagtgtttgaagccacggattgcagcgaattttgtgagccagcggtggaagaccgctttcgattgcccaggctacgcagaatgctattgctagtggagttgcctctatttcggccggaggcagcagcgtcagccagattgagctcggcactgtgagtggaagaagccgacgagttgttcgaatgctgcgactgctgttcagcctcgagtccagtggccttacgcacttcttcgagcgtctgttgctgtggctgagaagaaaacttgcccatgaggaacttgtaggacgtctccagggtgcctcccagtgtcacccgaatgccgttatcagccacattggaaactgcactttgggcatactctaccgtgttcatgacactagttcttcgagcggcatttgtgggtctggtgggtgtgttattgccactggcgatcgaatggcgccgtggaacttgccagggctgaaccagagcgctgatatcaatgttgggagccacgttatcaaggtcaatgccaatctcgtggggtagcacactttccaggaacgtaatggctgcctcaaagttagtcagacaatacaaggattcgccctgaagaccagagcttcgtcggaatcgcttgatgaacatgaggttggcccacaaattgggagttcgttcgttaaccagagtgtaaatgagagctggaagcatggaatcggcattggtagaagctgcgacaatagacgtcagagtctccacaatgttttgttgtgcctggactaacttctccaacttttctcggggggtgtgcgagttgttcatctcgagaagaatgtctccagcagggcgcagcatctgcttaaattcgctctctgaaatgttgggtcgtttgtgttttttgttggaagagtctggtttctcatgttttccattctttggtttttcagatttgtcggatttcgaagttccatccttctgtgtttctggagtctcctttttgttctcagtttctggaatgtcggtagtgttcttattctcatccttggttgtagtgaagccatcaaccttcgagtctgtttctttaccatcaacatcgaagtctgcagtatccttatccccctccgagttctctgtatccttctctggctcttcctctttgatttgatccttgatttcctctctctttctgtcttccacctcgttgtcaggagttacgccactcatcttaagttccaaattgtccatgcccactcccacttcactgagagctctgatccggtcccgcagaaagctgttgtgcgccttgtcggacgagatggtcgacgacatgatgaacagcttatcgtagacagaatcgcacaccaggtcctctgccagctggtcgtacacccccacctgcacatcacgtgcctcccgttgcttcttgcgggccgccatctcctggaacgtttccatctgctgatccttcgtcctctccagggctgcttgtgcgcagtactgcgtggccttttcgtgaaaccgcgcgtagaacttgtggaacaggtccgagatttcgtcgggctttagcggcgtggcatacttgcgttccagtagagacgtcagaaactcctgggtgtggcgaagaagaggcaacggcagctgtgtagcatccagaccttgagtagacggatcttcttcgttgctgtgttgctcttcggatgtggtaggcaccttgtccacactcttgtcatcctccgtggggcgagtttctcccttgtcttcctccgtgccttcagtgccggttgtgtgtgctgatagcagggccgaagagccactgtcgtcgtcgttgtcgtccattcgtaccatgcctcgcttggtggtgcgcgagagcaacgactcggaaaattcagacatgctgtacaagtagtgctggttttttccgcaggttaggatagatgggtgtgctgtgctgtgcaggacacatttaaccttgtgatagagttgctgcggtttgggttgtttaaaaaacagggaaaaatagagggcgatagaccgactttgaacgtgaaaatggagggtgcctgggagccaagtattatttttgaacgttgctgactcatgtaaacacatgtgctttattctggctacctttcaacgtcctctgagccgtataactcctccatattacacactgttgaggctaagccacaaacccaactagttgtagaccacggcttagcatgaccatagcatgactagctggactaaaacttctggctaggctcatttgggtaaaggtcaaatagatgaccaatagatgtcgatagaggtttttgtttacagtctccatcacccatataatatgtcgactttccttccatgtcttttcccttggccccacatttcagctcgtgtctttaaataccctacacccctgtttcacgctgggatgtccattctaatctgctccttcatacttgtgttcacgtctgcaggggacgtgagaatgggcggcttgtattatgtgggcgataggcacggtagagacgggggaaaagaggagattttggatcttatttggcatattaggggtccctgaggccatgccataatcttggtgtatttatttcgctctaaacgacttgccatggccacgtttccaggagctatttgctggggattttcacacctgcatagctcttttttctcccgacgtgccaaagttctatgccacctaaaccatgccgttataaccgagataagataaacgctatactgttgggatgcatgacatcatgtgcggttagaagacgcagagggggcatgacatgggaacatgagaatgacaaggaagcgacacggaaacgacacatgtggaagctggaaatgcagataagagcaattggttgcaaaaaactcgatatatatccagcccacagctaatcgcagacggctcatagatcaagtcccgctgagacatgaggtatttgcttaactgcaaccatgtgtacaaataccttcaagcttgggtcatctggatacccatgaggctccaatacttcaaaattaagagtcgggcagttgaggtatatgataagaggggtctgagcgaaataaccctcaactagctaccggctggccgcccctaatctatccacacactcctccacatgctccccacaccagcctaccaccccgaaattaaccgttgatcgcctttcttattccccatagggttagatctaagcctcgactatctggagttaagtcgacgtgttggaatgggagtctccattcctcagctgagccttttcggcacccgtgagaatgtgcgagactctgttttcaacccgccaacggcgaaacagacggtcattgtggacatctcagaggcaagcttctttcaagagtgggtactcgaataaggaagctttcgctactgtagctgctcgtagtgggctttgttggaccgtgtctctcttgaacgtcacagtcaccaacagtcagtcaagttaagtgcgtacgagagctcctccagctactgtagagtatcagagaacgaccactgtagaagtgctggtgaagcaacttgtaatatagcggtgccatctcaacttcatccttctgtcaatccttttaatctgtacaagttgacttagctgtgtggtcagcttaagacaccaacactactgcttctgaggagcctagactacaacccaccccctcactaaatgcataatttgaaccagcgggtccagtaactgggcgtctgggcagttcctcgatgctgcaacttgtctgaacgtctcctttcttgagatcacacggctgttgagggactcctggtagctagtttaggaactgatttacgaattattaacagcatgtagtagcctacattgtacctgtaccttacgagtactcgtatcccccgctaactacaatctctagtaatcctcagtttgaccttgccagatgtcaaaggaggggatgcccattgtagtcacagagcgacccatattattagcaggtatgtactgtaccttacttccacacgtatcattattgggatgaaacacaccaatctcacggtaaattacaggttctcgtaatgtacttgtacggaactgctttgttatgttgtaggtcacggtttggtcttcaactgtacagctcgtacttctagaaaatagtgcctacaagtagtgcctgcatgaacctcatcaggcagaattttcataaaattgtttctgagggatatcaaaagcaatttcccagaaagaaaaactcgaattaactaaatcaaaccatgtgatatcccctactagctcgatagcctcaacctccgattcaactgctcaatatgatctacttcatgcagactcttctagaacatacgaaggacttaatctgcctgcatgtgtgtccagaggtaagacatcacacgacacattacaccggatgacaggttagttccacgataaatataaccgaaaaagtctatccagataacccagatctacctcacagtcgcaaaaatacaccacttattccttcaaaccatcgggtaaacaccagatccaatctctcgggctcatgcattaatcatgcactatccgcctgcagcaacttactccagtacaactacagtccgagacagatttctgttgccgccctgaagatggacaggaaaccaatccgaatgctaggaacccggctcaagcggacgcgatcgcgggacgaacaatcgaatgtcaagcgtgctcgtctgatggatgcctttgggcgtctcaatctaggcgatcgaatggacgacggttcactatctcgacacaacaatgggggggttccagcaacagctcaggactccttggaagatgatctgtttgaggagaacccccatcaaatcgatgacagtgactacatggacacttccaacaaagacacaattttcatccctagcattgaacgatacttggaagacaaccccgatcccgtggatattatccccagtcagcaaaatggacagtttcagatacttcctacagaaccgccaacaccagatattctcgcccgcatttctcagagacactttcaaaaggtgttggacggttacacacacgaggcactggtgccttaccagggcggccctcagacaatagtgtgggataagttctgtcgatggtggcttggagatcagcccagaagggatgatacaaccatgagccaacaacagcagttttacggccaacagttcccgaatcagttcccgaatcagttcccaaatcagtttgcgaatcagtcttcggaccagttctcaaaccagttccaaaatcaacaggcaggtctgttccacaatcaacaatctccaaaccagtttggattagaaacatggtcaaataccggcacgagacaccactcagaggccatagacaacggagatatggatatggatgtggatatggacgaggatctgccagggtataccttctacggcaccagcgactttactagcccagataccgtggtgggacagaccgatccggactatatgatggacgacgatgcccccatggatggaaccaggagaaactcgttgcattaatcggctcttctgaagtgggcgtctactaactgtacatactgtaataacatagactgtatacctatcagatggtatacatgtataacaccaagtgacacgaccctgtaagcgagccagtgtaagacatatagctacccgtacggtcccccgatccctcaaatcataacacagccttaaaaatatatgctacacctaaaatacacaatgcccacatcgtcttcggacgcacctcctggtggtggttcaagttttcaaacgggttgggtgcaagacgcgcgacgctcaatgcataaagagcgatctataatagttcgaaccgcagtttatacagatagtaccaaacagacagtttgaagcccgctttgaacagccagaaacgcgaaatttgactccagcactcccaaaggccactcttaactagcgtacaaaactagcttgttctttccgtacactgcagcgcccagatcctcatcgttgctgataaccacccggctaccgtcatctgccttgtacagtagactcagcgtctcgacccgtaatcgctcacacaaccggtcgtgtagagtagcgtaatcgatgtccgagggtactcgaatcgcaatcagatcgtcctgatagaaaaccttcaccttgaccgagttagatgacgactgcggcgtattgacggcggggttatcgggcgtgggacccaccgtggacacagaggtcattcgctggtgtccgccgccggggagtccggtgggttcaggaggacccatgagacccgatgcagtgctcacaggccgagactcctcggtgccttccgaatagcttacgctgctggaagacacattagtcggccccagagatttgggatgaatgccctttgcccgcgcctcggcctgagcggcgtcaaacgactcggtctccggcgtcagaggctgtggaaggtcgtcggtgggaccggcggccgccacatcaccagggcggagagcaaacagctcctgcatgatcacagaccgtgaaatataagcgggaagagccatgagcttgcggacgtactcgtcaaggttgtgacgtcgctgcatggagatggagtcgttaacgtaggtaagaggcccgggcatgaaaggaagcagacgaggctgatcattgtgaccagcagcctcttcgaacacccccagcaggttgatttggaatacgtagaagtcctggtagtatcggcacaatcgccgcatggagccgtcctccagctctgcgttgacgaggtaccagtatcgacccgagtgtaatgcaaacgactcgacggacgccgctacaacgagaggtccagtggcaggggcagcgtaattttcccggagagcctgctgttcccggagagcctgctgttcctgcagagattgtctttcttgcagagtctggtgttcctgttgaacctggtgttcctgcagagtctgctgtccacgcagagcatgctgcagagcctgctgctgcgagtgttgctgggggtcgtcaaaattgccaagagcaatgctggacgccttgtagtctgctgccatccttttccactcttccaccttgggcaagccagaagcccgtaaggcagactccacgtcgacaaccgcctttcctgtcactatgtctctgatctcgataaacgaggcagggatcagaccggggcctcccagtcggccaacgggcttggcaacaaaccactcgtgattggattgggcctgaatgatgatgttatcgcccttggatgcttgcagctcgtcgggccgctcggcttggaagtcgtagagcaccacgccgtgcagagtgggggtgctcttgccctgcgacgatcggtcggatgcgcccgccatggagggttctctggtgtggcctccggagccagatgcgccccctaaactgaggttctgcatggactgtgaaacgtctagcccattggccagaacatgttgaggtgagtgctgagcatgcttgctctgactcgatctgtgcagcgcctttcgttcttcggggagaagagcctcatttgggtcgggcgaggtgataccctccttcttgccgagaacctcaaagtaaggcacgggcaccatgcctcgcacgttgcgcagcgggttgaaagcctcaaaccactccgagtcctgttcgttggaaatcacgtggaaaaagtcgcccttgcaaaatgagagctcgccgggtccttgtggctcgtagtcgtaaagtgctcgaatcaccattttcggggggttcgtgtggagcgggtttttgtcgctgaccagcgagttggccgagccagacgacgtggtcttctcgcctttgagagagcggcggattccctgagttagtatacggaaccgaggggccgtgcgtcaggagctaacagcagccggcttcttgtgtcatgacgtaaaaaacaagcccataacaacaccaagtctgtggtgacaaggatgtaaagagtcataaaacagcctttaggagggattggtgaagtgatgggtatatcgatggggtagctccggttggaagggtgtttctgctcgtatgccccaggcctggaaacagaaacaaaacgagcttggagcttctatctggtcaatgattgcgtagtcaacactgaatatgggtccgctgaatacacggtccatgcccctgactagcgcccggtttagttgcttatcatggacatggcaatcacactgtgacagccccaaagctaccccaaagccacacagaaacgatgaaaacagcgatgcagaacatttaataccaacgtaatctccagttctgactgttcccatgtccaccattgctctttctccatttccgttcatgtttcctctgtgacagcatggggtctccactcacgccacagcaccttcctaggggtgtaacgacatctggagacatgctgggtgtccagcgagcttcgtggacccatcacacaccctcagcagtccgcatacggcctccaaacagccgttaatactcaccttgatcatttctcaaacggtagggacgacggatactgaaactgtgtttgcactttgcctttgaaaccttagcaccacagggatgattagtggggtgcaagtgggaggaaggtagtgagtataacttgtgtgaatttcaggaaagcccaaaagtgatggagggtgtgtaaatggggcttgcctggtttatttatttttgaaaacaaacttggcctcgatattttcagacccccgctttcctctctctctcattcttctaataccccctttatataaccacactgccccatgggcaacatgttggcctcatttgatcttaaccacacccactggaagttggagcttaccctactttcatgtccgtggtgtcataatctgtcatgcggtggtgctgcaaagatatctgtgtgtttaaatgagtgtggaacggtgcatgcagacgacgactcagccgtgccaagcccggatttggctttctccagaaatatctctaggaaggggtaaatgaggagtggagtccctcgaatctgctggtggttgttttcttgtcatacaaagtcatgattccatttagcggagctacttacgcccggctgaagcgaacatgctggatgatcgccaccgcggttgtgtctacacccctcgcatcgactggcactttcgggctggatcaatattggatccattttgggcgtttaggttatgtaaatgcactgtgccgaaagaggttgaatgtttgttcaaaaagagattgaagatgctgccaaaaagtgtcgccatattgccatgtaacgtacttttacttgctgaatgaccccgaaatgaagctatttacccatccaacactcttggtcaggaagccctttttcgttgtactcaattgtcctgtccttggtggcctatttttagccccgtaggctttagcgtcaataacgctgttctgaagactttttccttccttaatattcttatttgacagaaaatgtccactcctccgcgcaactctgttgtgaaacaatggtgaaacgctgctgcgtagagtgggagacagggatccaggccgtctgagtaacacccacgtttacaaacccacacagacattcgcattatctcgggagcttcataagccaagtggctgccatgaaaaactctttgttggtagccgttgattagggcagttttgacgaacattagcgtggggggcagtacataccatacaaatacagatctgtaacacgactgaattgtccaggagagaaaaagaaattcttgcagaggaagatactgtgatacacatggttgtctcggctggtgcggagagagatctggaacaccggacgagccgccagtgaggattgcttccgcagtatgtactgtaagtactgtaccgttaaaagcacgagactcgcagacctaaaaataacagtcaaggctttgcaaccagcctaagccttgccaagttaccaccttctacctatacagcactttcttagattatacgagactggggcgtgtcgtgtgccctgtgctggcgcttcggacaattctttcgataacagaaccttcacttgattggagcaccttggcccccttcgattcaaaacgtaccggctgatgtagttcctgttctcttcctagctacgacgagtctgacgagtatgtatagcaagtatactgtagcaggtagtttcatggctgatgaccctggtaataatatcaagggttatatctcctatatgacgagcaagatcgagggacacacagagtcctttttcctgtactcgacacggggactcaatgacttggctttaagacttcacttcatgaagtgcgccttcgacgcactgctgctacaggtagtgctgacagaggaagggctttcggactggcacagtatgtactcacccgttatcggctcctctagtcgtacaagaggactgggtgccatgactggaacttcacgtcatggatgtggttggattcattaattgattcattgtattggaaaacactatcgttcttttttttaactgatgactacagacaatgcagtatgaacatacctaccgaacatcgatattgtactgagattaaaatgtggctactgtagtgaaaatgaagaacgaactagttgcgtgagtatatggatacttcaaaaacacgatgccattatctttttcatttacggctgcaatttaacccaccgattcaaagtacatcgattcgaatccaccccaattgactattcagaccatgggttaactactagtagctcgagatgacgcaacgatcatcttcaccgggcattgaatctacgcacagcgtgggttggaggtcataaacattcgagaaacatggaacgagatcgtctgaataagcagcccaccacagaacacaatggctctctttgacctcattgatattgggtgtacccacctactcaatcgggtgtcgatgacacctcttactttactactctctgtccacgatggagtgccttcaaatattccgataccgtacatactatgttcaacgatcgcacaaatccggacgcagatgacttggaagccaactatgtgtttcctggtgctagacactttccttagagtcagcgtctggactgagaaacagataaggccgtgggaagagctttttgtcgttctccatgctagatagtgcaagttgtacgtgccattgagggttgtgggacaaactgtcagctacccggtgctgcagactttcctgtagtggatcccgctgctattgttcagaagatagatcaaggctgtgagtgaggacgagattaagcagaagatctgccattatgcgatagcagccgaaaaagccattaaagctgaagccggcggagttgaaattcccgaggctcagggatacttgccggatcaattcatccactggaacttcaaggaactgatgaacccatacggaagaaggaatgaaaatagatgcaggttcagtttgaatattgttgatgctgtttcgacggctagtaggacggccaagactgtcattcgactttctccctgggcttgtgtgcaggatatggctgctcaccaaaccaagtcttcgccaacgttcgtatttattttccgagaactccaaaaacgagcaggtcatcatggtcagaagctcgcgtttttgcatcttgttgatctccggatctaggtatcagtcgaaaagagcaggaacagaaagagtgacaagtccatgagccattcagagagacttgaaaggacctctagtggaagcaggaggttttagtcagaaaccccggaagtttgtgaggaatacccgttgactctcgttgccactggaagatacttgatcagcattcctgactaggtcgagagactcgagaagatgaagatattcactccgtacaacatcgacaccttttacacgacactgacaaagagtgctccactgattatccttttatccaagtaaaagtatagaagaaatactacgaatcaggtcgccatcatggtacatttttttaatggaataaatggtgtttttaatggaataaattccggtattttttctacagacaagatcattaactgataattaactaatttatcaactaattaagctcatttactctagtgacaagttgtattgtaataagacgcgtaaaaaataaaactagtaaaccactgggtgttaatagaagcagataactgaattctcgtaatgaatcagcctctacaagccgtattcttttcctcaaagtactgatacctgcacatacttgtactcgtacaccggtactgtactcatacttgtatcgttcgtaggtagtaactgcacaactctgcactcaacttaaagcatacattatcaggcccaatcaagttcgatctccccttaccctggctctatagcttcttgctgtcaagccacaagccacaagccacaatgagttaaagcagtttagcgagacggggagagagcacgattgtggctagtatgactagttacatggtggtcacgtgatctcttaataaacaaagtccctgagggattgcgcccctacgctctcctcctcgtaccacctatcctctctccacccacatcacatgacatgacgtcccagctgcagcttgcttctcttctctaacatgcttcgactacggcaacttcatcacttgacgaacttcaaaaccagcagtatgagccaatattccgccgaactcaaggtcgccaaggacgctgtgcgacgagccagtgctctggctgcttcaatcgcttccaccatcgccacagacacatctggacaggtgaccaaaagcgacactagtcctgtgactgttgcggactacggagcccaggctatcatcattggaaccatcaagaaggccttccccagtgatcccgtggttggagaggaggacgccgacgtgcttcgaaaggacgagggtctacgaaccaaggtgtgggatctggtcaaaggccatcgaagctcctccgccgacgccctcgacgacacaaacgctatgctcgacgccattgactggggcaagtacgagggaggcaacactggccgaatgtgggctcttgatcccattgatggtaccaagggattccttcgaggaggtcagtatgccgtttgtcttgctctgattgttgatggccatgtcaaggtcggtgtcattggatgtcccaatttgagcacgatccccactcaggttgccactcaggaaaaaaaagatctgggtgttcttgctagcgccatcaaggaccaaggagctttcattgagcccctcagtggggagtcagacccctctcccatccacttccgacacctccacaacactgccgaagctaccttctgcgagtctgtcgaggccggccactcttcccattccgatcaggcacagatcgcccagaagctcggcatcacaaaggagggcgttcgaatggattcccaggcaaagtacgtggctgtgtcgcgaggacaggccgacatctatctccgactgcctgtcagcgccacctaccaggagaagatctgggaccatgccagtggaaacattcttgttaccgaggccggaggaaccgtcaccgacaaggacggcaacgctctcaactttggcgtgggccgaaccctcaaggagaacaagggcgtgattgtggccgaaaagtccatcttccctaaggtgctggaggctgtcaagcaggttcttggttgaaggaaaagggtaaggctagtgcaaggctgaaagagaatcggcagtggttgtatatacattattgagtattgagagttgaagatgatatgtggacgtacaagagttgcattatgggcctgtccaaagacgagactgcgatatcggagctgcgacttgtgggagataacatggagtatggctttggtagatgagctttggtagatgagctttggtagatgagctttggtagaatgacagttttgtagcaatgacccttttactgcccacgattcactttgactctacagtatatcattatgaagatccatgagcaagccctccataaggagagcctacaagtacattaccgatacttgtatgtcaagtcgtattctgaacatcaaaggaatgtcttagttgtgaagtcacgacgctcagttatatcgagagaaactcatagttgtcggacaagacctttgatccccttaaccggttctgctgttggtttttattacataacgatgtcgattaactggtttttactggctcgattccaattgcagatggtctatctataagaaaactacatccaactctcggatacccttacagaatgtacaccaatattgtacggcagtgaacactcaacccttcaatgtacacggtaaatggttcacttttgaagctttgaatgttagctatttccggtgcagtgtaccttggttccagcctcctctacgacaagtatggcagtcctcaacatcagccaccctcggacattggacactggtctcgtggctaatttccgattgtggcttgtgtgcctggcttgtctggaactctaatattttttcgacgttatttccaggagccgatacaataacaagccgaaaaattacatcacatgcataattaggggtctggagttggttgagccgagatttcggggtgtccaagagattgcactgagagcgagcgtacaggtggcgtgtcccatgggggtcacgtgacgtctcatcgttccgatctctcctctcaggtttatccagagcgtgttctttccctaaacacgaaacgcgttttcaattaaacgtctcggaacacaccggctgagcgggaactctaagtagccggttcggcgttctaaagttcaggatcaagagaaacttttagcttagctcaactctttgtttgagcttcggttggtgattagccggtcggaaaatgtgccaaaaagagtgccaaaaccaacactttcaaagtgttgagttgatctgtgatacaagacagataatagatggaaccgcttgggcaaatgcccgagaatcttgtacaatttctagttcatttatgctgattttattccctatggttctcgcaatgccaactttgactgcgcttgtactcctaaaacaccttcctcggttttcgccgttctcgcacatcttccaaaatccaccttatcccccacatccagcagcacgtacacatgcggaaataccttaaccatctctcatgatcgtttggactggattttggatggattgggtgcattagtgccggagttagagcgaaatgttggaatgcgacattttacactcaactaaacaacatctattagttggcaaccttaactattacttaaaagtaactgtaactccactgtctaaacagagtgcactgtatatattctggaaccagatgtgccgtttgtcaggggagggaggaggaaaaacaaataacattcaatttagataccgacacgaaacgtttacagggctgtattatggctggtacagggttgtcattttaatgactcacctgtggtggccagtaatcgaacacgatagtattgtatatacaagctgaatatagccatagggggagcagataatagccttgactaatcagcacgtgaagcaactgttatgatgtctcagcaactgtctttggatgacgtgtgttgtctggtaaaaggggtgtcttacttcggataatcgttcggttgatttatatatgcacaagaataagtagacgttgacaaaccgaggaatatgagcgccattggatccgctcttgcagtaaattgacacaattgagtcacgtgtatccaatggttaccacgtgatttcgctagctccactacaatatctcatgttaccctcttgtccgtgtatcaatgtctcacctcatcgctatgaacgttgctacaagcacttggtttacacgtgatgcaataactgctggacaggcgtcgtcacttatccccagagaacaatagagccttgtattgtcgttaatatcacagcagtatttttctttattatattcggcgctaattagcgtcgcatgtctggattgccaaaagaatttcggaaatatccgctggagaggtcgagaggataaaaacaaaactacgaggtcacaggactcaatgatcggtcagtaacgcagccgcgatcatgtccacgttggcccttgtctttcagatccttcttttaaactcattgagtggtgttttgattttctgatttcttgtttaaatttttttccactatcgaaactcaaatggctctttgtccagacaacaaataacgaaaaaaaaggccgcaaaagcatgttgctcaggcgtcagtcaaaaaacaatggggtttgggagagaacttcacgtcgcagtcacgtgagggatcttgacgcggtattaaggagttgtttggagaaatggtttctataatgagataggggagtctgagtcaaacaaatagtactccatgttgttctctgtggccgattgtattaaattggtaaccttcttgtggtcacgaagcaaattgggtctgttagaagggctgaaaatttgttaactacagatctctacctctgttagcttttagttgggaccttacttgaggtatatgcagtagggacgaagtagaacctctgatatacagaacaaaaaagatccgaaatactatgcaaaagctcaaagactctcacaaatgaatttatcaccccttaaaatataaatcacccccagtgcgtgcttttttactccctagagtccaatatcaatagatgaatcttcacaacaagaacagtccaagaagacactgcacaacccatcaggaccacctcggacggtctggattcagtcgtatctatttgattccctccaggacgtagggagatcaagactactactggttgatctgacgctacgctctattacatcgtggaagaagaaacacagggtgtgccactgatctcacaccctcgagccgcgctcttgtgtgatgggatccactccatgttttcgtgcttcgctctcacgcactttcgtgttctttggtgttataaataaatacattaagcaataatttgctcatctagatcgtaaaaaatatcctccagattcagctccttgggctgtgtgattcccgagtcctgccattccagatcgtcgggccaaaagtccaagttaggctgcgaaatgtccagactcaggctcatgtcgaggctcatgtccagagtcgttgctggagtcagcatcatgtccagcgatgagtcggtcgacacgtctgacgacttgcgttttgtggggagcgataacgacgaaggagatatggtcgtgttgacggcggctgtggaagaggccttggtgttggaggtgttagcggaggctgtcttggaggctcgtcgcacgactgacggtgtctgtgtgacggccgagggggcaaccgtggtgggcactgcggcgctgttggcggacgctccacccacggactttgctcgctttttgggccggataggcaccacgggcttggggagcaacggacgcaataccggagcgggagcaatggctatggggccattggtggccacgggaggggaccgacggcggttagtctgcgttttcttgtacagtttggtgggcggtttttccgacagttttcgcgccaggctttgtgccggggtgagggacttgcccgaggcagacggcgcgccaactgcgatagacgtggttgctgctgttgtggtggacactgtggtgctagcagtagcggtgatggtggtggtggtggtggtggtgggagcagcagtgattagaggagcaacgacggtagctgaacatgtgtttgtgtcggttatgtttgtgtcgtcgaccaggccttcgacaaagcccgccaattgggccttgagagaggcctcggtgtcggttagtgatgagtcgtccgttgggtgggccggattcgaggccgatgtgtttgtgtctgccggcgaagacacgtcgctcaatggactgccatttctgtcaaaggtgtccgagtcgtggcctggagacggcgattccgagtcggtcatgtggagcgtaaagggtgtgttgagagaaagtcgtgataatgagaatctatctcttatgctacagtctgcgtgttttagtacaacgttttgcacggacaagtttcgggtgcaacaagagcctaatagacttctgggtttaagctgagaaaagagcttatttggaaaatgcggagaggtttctaccgagtcgggaagtcacgtgattgcgtccggaccatctggaattatatccttggtctccatacggccctctccaactttctcccgccctctaagtccacttttagctcttccaacggacatccccttttttcgcactcttgcttccatctgccccgggtttgagacgcaacgcaggcgtgaaaaattgctgcaacaaaacgggaaacacacgggaaaagcgctgggtgcgtcccatgctcgaattgacgtttccccagctgtgtgcatctcacttatcgcatcaacacagctttttcgtgtctttacactcttgcaactagcgttcggagatagcagcctcgaagcagtaaaacttggggtaagccgaatatcgtcggcggaaaattggccaaaataaacaaatcgttcccgtcgttggcaccatttctcacgtagttccactaggagtaaagtacgagtacttgtcgcccatccccaacacgccaaaccaccaaaccaccaccaaaatcctttaacctcatccttctcaattttagacgctgcaatcgtccgagaatgtgttgaaaatttaaacattttagccttgctacgccaattgagcgagggttatgagaatgggaaaaccacagaccacatcttattctccaagccattctcattataaccatgtattttgtgtgtttcctgctattatattcgatttaaaccgaaatttcacttctttggctttagtttcaatgcagcactttttttcttcttcctcatcctcggctttgtctccttgttagcacggttcaagggcaatagggttgcatgttgacgctttcacgcaagcccatgcatgcagttatgcaagtttatgcaacctctcgggtcttttcggaaccccatgtttacaggataatcaacgaccggatgggtggagatgtcaaaatagtaacaccggacgttgtatcgtcggcccatcacgtgacaggtacctgacatgaataatcacgtccaacccgaacatgtgacatgagtcaagcgcctagtgcaaggccctacattcactttgtacatataataccgctcataaccgctgacatgtatgcacgaaaaaagtaaacaaatacagggataaacgggggcacgtgacgtgtagatattatcggacttctgacgaggttatgaccccaaccaaattgtttagaagaacgcgacttctccacgacatctttcctccaacgttcctgtctcaccctttttagcacgtttcgacgatgaagattccattcgttaccaccatctggaactctactccacgtgactttaggttgcgcatcgctggtcatggtgagtcacgtgaagtagccgcccaatttccattacctttactcggcgctgccacccctgcatcctctctcccaactaggaatccacatatcccaaggaagaagtctaaattccgattaggcagtcaaatgggtaaataaaggttagggtaagaacagctcttcgacctagcccctacctcggcacgtgatagttgcatgatgatgatgcctcccaacctcaaaagtggagccacttttccagccacagcaccagccacatatatcagccccaggcatgcagaaaataacaaaaacgcggaggacaagaagaatagattccggtggcccgaacaaggggaatgctggtgcggagaagagacagataagtctttgctattgtcttccctgagttgtttgataagtacgtcattcactcctcgcagttccctccacgctggtattcaggacctacaagtagtgagcgatgattaagtcccagatggcacagggagggttgtccagttgccggaatgacgaagcagtcataggcaactgtcggtttgtttgttttcaatttcttgtctagtaccacatgtgcgcacatatgctggcactcgcagcgtttcaggcggcagctcttgctagacatcattaatcacagagaatgacgtgtataaatagcatcgatttgggttgagacaatggctgtcgtgaccaccatgacgtgggctctggcgacgagacgagtcacgttgctatgcgtcattgtttcgtttgaggggatgaggaggatgccaaggactccatgagagggcggctgcgttgtatgttcagtatcgtcttgtagttagacaaagtgtgtgtctggcactaatgacttcgatgataccatgtagagtggagtgtacaagtacaagtacggtaccagaagccactgtagacggatgcctctttgagatccattggagtaggagttttgctgtagctgagtcttccgctgcagtttcatctttgaggggctcattaggtgcggaagtacatgaacggaagcggagatacaagtacaagtagtagtgtcggtacaacttgcaggtgttcgtattcatgcgcaacagctcttggaagaacggaaaagatgcagtggtggcatgcggtggaactgcagagactttcattgtctggcgttctttgtcgagagtgcacagaggaagtagccgctgggatggcggatgtgaagtgaaaagggcagtacttttagtctctgtgttaggtcgtgttagaagtttgaagtagatacgagggtgctgtagttcacagggtgcgcactttcacattggagagcggtggaactgcgtcgttggagtggttggtgatcaacttgaaggctgtcggtagtgccacacgtgtgcggtgcgacatgaggataacatggaggtggtttgttgtcagcatgacaaccttgtgatgttggttgtggtttgtctggtaccgtcagttggcgtgttcagattggcagaagataagtgtgtatcttgatttctcagtgaggtcatgactgtgacctgtctgctcccatagttgattctgatcgtactgtgggtctcctgtatgtcacctgtacaggacgatgactgttaatgtgccacaatctggtcgcttcgtgaaacggcactttggtgtgtgacggaggaaggagaagaagagaagactaggtagaaatttttcgtgacacccagtttgtcgcacttatgcactttggaacaaggttccggtcgccctggttaccacaacagcccactttaaaataaaattaaatttgccccatatttcggctgcgtccatgataaggcttcggaagtgttctgcagcagcctgcataatcatgtcttaaactgaatgttattctaagacactcaatgatgaggtgtagagagagaccagaagagaagtataggaagcaatatgagagggacagtccgctggagtattataaaacaataccttttgagctgtgtgatgtagatacagaggctctcgtggaagtaaggtgaaaaaataatgttgtctcatctgcgtgtaatagcgtaataatccacccatagttaaattacttactcaaatcattattcattaaaaaaaactaaactaacgtagcttgaaggctactttttaaaccatcacgttatcgttaatgtaaccagcagcagctcgttcagcagacatcttctcgttagcatgctcagactcagagccggtgtcttctctggagtccttctcgccaaactgctcctcttgatcgtgttcactttcacttccgcttccctcgggaacgccatgaatggccatgggatcgtcctcatccatttggtcctctccttccacttcgccatctctggcagcgctcttgaggtcaatggaaggatacatgagactgacaatgaccatggctcccacacaggcaaagggtccaaccagcatgtgtctcatggtctcgttgaaggcatggttaatctcggttcggaccagcgaacccatggggaacttggtggccttcttgatcttgttgatgatgaggttcagatccttgtggggaatgtcgggggcatacttgtggatgtatcgagggtacagctcccggtatatggcgccacagatggcgtctccaataacctgtccgatacctccggaagaaaagtatagagcagtcacagcagcgaccttatgtttgtcaaacatggcctgggccatggtagcagcaggaatgtaaatgcagcctcgtcccacaccctcaaagcactgagcaacaatcatgattgctagaccagacgaaggctgtcggtagtggtatgtaaggccaattccgatgagatggaaacagcatccaaacacaagaactcgcttaggtcgaccactccaccacatgtaaggagcagcaaagaacattccaaagacgttagaggagacaaccagcacacttgaaacgttggtagcagccttaggactctgacccttgacaaccataagccaggtgatgaagtaggggacgtagagcttgtttgcgagcgacatgaggaaaaccagggcagcggaacagcacataactcgactcttgaatagtctccagggcatgaaaggggccttagggaagtattcccagacggtgaaaaagacaattaggaaggaaccgatagtgagcatggcaatgtaggaatgaagcttccatctttcagaaccagcagcaagagtaatggggaggaagaacagaatgagacctgcacacagagtgacgagtccgacaacatcaaaactcttgatgaatcgcaagggtcctccaggagaatagaagtcacccagaccgccagcctttcgctcatatctgattcgcatgtatgccatcatgatgactgtaccgatggagcagacaggtagaatgatagcaaatgctccatagccccatctccaggtggtcactttgaggaagcccgccaagacaggagcggaaatccaaggtgcccagatacttggggtctggatgaaactggaccacagaactcgggtgtcggtggtggaagtgtcactagcgtatagttccatcatgagatgtccactgacgattccgatttcccagaagacagttcctgcaaagtagcatccaatgttaggagcagcagcatacagaatggagcccagagcgtgggcgataatgacaacacaccatccctctagtcgacctagatggtcagcaatcttggcagcggctggacgggtgacaacgaaaacagctgactccacgacagactgagacgacagaagagccaaaccactgaaatgagaggtagcgaaaggggccagagaaggatagagatgttgagcaatggttttggatgaggaatacaggtagacgaagatccatccaatgatgatcttcttctgggtccagcctcgttccttggcattggtattgcactccttcttgggatagtgcttgactggggctgtagacagaaagacttcgtggaagacctgtttgcacttttccattgtgggaagagatgggttgattgatcgattagatcaggaatcaccacatgttatatatctgtagatggagatggagagtttgcttcgaaaagtctataagaagccaagaaggatgccggagtctaacggaaaggttgttagcgagtttgaagatagaggattgtctgttggtatttcccagtgtcttctgggagttgatacattgttcaatacgaggatctcttcgatctggctggtagataagaaccgaccatatgtgaagatccccggtcgtggtatccgaagcgatctagaccaaatttttctaccattgaaaccaatctcctctatgtctcaatagaaccactaggtttgatcagacatccgcatcctgacgcatccagatcgagtgggggtaaatgttatgcgctgcgtggaatccccgggacgcaacggagaaagagtggctagttgttggggttttaatatggtcctataggaagactatgttctatacgatgctttagtgatatctctcactgtctcagcatctgacggcagccttattagtcatacacacagtatatggtggtatgtcggtagcgtattacttgctgcaaagtagtcaaaagcctagctacaggcgaggctggtgtagccaattgaacagtccagctctctcgtctgtctcgtagtattacaaattgcatgtgagttcgaaatacaaggttgcgcaaaagcaaacagtgatgtgagtgtatatcgtgcggtataacgtgggggtacacgcttgtgtatttcaaataacacactacttgtatgaccactaccttcatagatctttggttacttgctttccctctactcgcattggacccaggtcatgatatcaccatcgatcatgcaagtgattggcagggtgtctgagacactctttggatcaccacttgtgtgtagctttcgtacaagccatctatatacagcgttattggctgaatacaaagcctcagtaccacttactggtatcgattgtatctagaggcatctgtttcattcattgtgtccactgttattgtcctacttcgaatccaggacctagcgaactatcaatctaatctactgacatacacatttcttcttgtgctagtgtacgagtagtgtcatgattacgctagtctagaccggaactggtgagcacatactgcagccaagaagagccgtgtacgtctttggagaaaccttgaagtctgtgtaaacgtggtcaggctatagggaggaataattgcgataaacaagtgtctgagatgtggtactcagtgtagctcgttggtttctcgttgattgtcgtgatactttcgtctgcggtagaatcaacacctttgcaattgcttgaacagtctcacaatccaagtccccctttctggaacccgaattaacccctgccaagaactccctgcttcacatttagcttataaagttgcgataaaaaaacttggcgtgcagatcccgcccaatacgtctttgttaggacggaagatgcagaagtccgacgaggaatggcccagacaaagaagaaaagaggcctcctatttagatgagaaatcaggaactcttgagacagaaaaaaaaaagctacatgcatctcttctttcacgtgacttgtattcaccggaaggcacgcgggaaaaagtaactttttggcattatactacaattgtagtctagacccccctctctttgctacctcccacgttttcagccaccttgctgatcgacaagaaggataaaacatacgggagtgcggactccgttaaatcgtgccacactaaggaggagattcctttttcagctacgttttatgtctcgagatgacctaacatgagaccagagcacagtatgtaccaggatgttagtaagtgccgtaccaacgagcaaggctcttctgtaagacaacctacaatgccatcagataagtgccgttcataacagtctgtcccttcgctctccgatgatacattgggattatggaagaaaatttgactcgctgtcatgcgtctgtttttcgctctgctcttggcaacggcactgggatgacccccactcgaaaccttgttgttattgaactctatgaccttgctgtcaatcttagacagttagcaggtcaatagggacgtggccggcggttaagtcacgtgatcggcctttcaactttcttcagttctttttttagctaacccttgatcaattttgtcgcaatcaaagtggaccgttcgatcaggttaactataatgtccttgggtgaggcgacaatgaactcttcaaggaggtggttgaaggtgatgatataccatcggattctgttttataacaagtcataatgacgtctctggaacattgtgtcttcgatgtcggatctaagatgagtgcataaaagcttagcgggtacggcctgtataactgctacttgtaggatcatgtactcgtatatgtacatggaggcgctgtatttcatctgtctttcagcgagattaaagcaatccagcccttgtacactgagaccacttcggatatcaccggtgaccgtcttcaataaatcattcatgtttgagttctgacggaacggaacaccgcttccgaaaggattatagaaaacgatagccagggtcactattgaaagacattgtagccattaaattcattctatacgggggcttattcatgtcttattcattgttttcagtctctatcacgattaccagctccatgcatgcctagttttggcacacatcacactgtaccatgacacccaaatgagtaaagtcaagacaattcgttctcaaagatctatgtttccatctgtctacaaccgtatacctcccctgcccttgcaggtctcgctaatatgaccttcgttggggtaccttgtaacattgatgagtgagacatgactgcctctcgtgttgtaaagttagaggacaagctgcgggataggctccggaatacaatttagagggaaacttattagaagcttgtagatttagtgcaactttcctcaatctggtgggtccttctgaaacactgattagagtgatttcgatcaaatccatcaaattgcaacacgtgtaggcagatatcgcatgtttccgatagctttcagttgttcccacatggggacatgaatttggcttcataaagttattgaaaaaagtgctcgtgtgatctctagaattcaaagcggcttttgatttcaagcgatccactattttatcttatcggctaaagctaagtagaattccaagtaagctctcaacaatacttcctagtctccagaaatcatcaaccacggtttaagcctactcggtgtggttgctggttccatctggactactacagtatgtacatacagttgtgattctgggtgttccgtgtcccgaaaaaggaaggcccaactaattgtgttcgtttctcagatatgttcgaatatgtgaaggcagtcttagtgccatggatcttgagaagctaacttttgattcgaacatttctttccggtctttttcatgctaatctcttgtattcggggagcattcttgctctgaaggtctgagcttggggtcagctgcaaatcctgaacactaacgagagccagaatgaagacactttccccttagacgaatggacagaaatgacgtacgttatgagactgcattgaacggctcgcagcattgatatggcgtcgtattgcagggattgggtacatcagtcagtctgagtcatgcattcctataccaacttgcagcacctacggaaagaatgaggagagagacgaaatttgtgtgtctaacgaactgtactcaaaagattttttcttgtttcaattgtaatttaacccttaggtttctctaccaatagtcaactcgaatctttcggtatttgcttggttgctatgctgaagagtttctccttgtcgaggtcttctgtggggaactgatctgatatttgacttcttctttgtgaaaaaccagtcaaaaatatactcgttgatctgttcacgtggccattggttcgtttttgctcgacttctggtcaaaagctctcttcacacatactcctccagattagctcacatattgaacatccctcaaaaacttacaaaatgagacaaagatatgtgaccgtgacaagcgaatgttgcacgaaaacgtcagttaacgagactccagagaatttgggcttctgtaaagttgtacaatttctgatcgctactgctatgcgtacttgtatcgtacttgtatagggtcacgcacttctgactaagcagcctagccgtatgggtacaataggaatcatacaaacttggttgttgtcgactggatactagggtcctcgttctcattaaataaaatgcgtgcattaatatatacagttagtgtcggagatttgttcttgtgtcgcaacttatgacgacttgaacggtcgaatgaccttcatcatcatccggttgaagccgtttttcttgtccaccttcttgctgtttttcttctgtaccttgtggctctctacgttctccacacaggcggtatttgtggctgtctcaaaccgttccaattcagagtcgagctcctcgatatcgatattgacctgaggccgcttgatcagcttgctgcttcgatgcttgactttcttgttgatcttgtttggcagcttaaccagctcactagggaaccgaacaagatcctcggtaaaggtagaagcatgaaccaagggcttgatttcaggacgcggcttgataggacccaagttgacggactgctgatcgtccacaagagagccctgagccacccgattaagggggttaataccctcgagaggagaagagttgtcaaactcaacatcgaatacaggctcgtggaaacaggggtagtcacgtgccgagtccatcgagtcacgagaaacaaagctggggcaccgcagatccccccttacgggcatggggtattgatggggatggtattgctgatgtgtggtgggggtcaaggacaacatgctctcccggtcctcatctatggtgctcacatgatggtgacccaggggcacctccaggtggtcatgggatttgatgcgtgacagcgaggtatcacgtgacgagctgtcaggcaccagcgccgggatctccaggtccagctctggccatggttgggcattgatgctggacatctggggtgacactggtgcgctttgtgtgatcttgggcaccgcacttgtattcccattatggatcttattgcatgatgcggcaattaaggttcggggtctcgcacaggtcgtatgtatcgtattagcttcactctgggtcggtttgatggaggtgtggaagtactcagggtcggtttctggcgtttctgggtacgttccttgcttgttgttgaaggatagcgatctgctgattcgcgacaggtcgaaagatttcatttttcgtgtgttttggatggtgtgtgtcatgaaaggaagagtgcaaaaaagatgatgctgtaaaaaaattgatgcaagtgagatgaagaagggttcaaaaaggaaataaaacgtgaccagacgtaggggaaatgagatgcaaatgtcgcctggaaatttccatgtcaccgcaacaggtgtgtgtgtctttttagcggggagtctgggtgttgtaggaggggtaaagtatcatacacagtcgtgtacacagtccaggggcgaaagttaagagaggcggactattcgtacaagtagtcgtcgatgtgaagtggcgatggagcaggttgtgtttgtcaactgtttgtattagttgtctgcaccgattccgtgtcaaagcaggttgttataagacgcgacagaaaatccccagtacttccagtgagttccggcctcggttcggggttaacggagatagcaggttgttggagttgtgggcgctatggaacgaatccgagattttgggcttgttcggcgggttgtgcaggtgtcttcgttgcacttgtgaaggtgaggagaaagaaaaagggcgggacaaggtggttgtatatcttgcttggaaatgccctgaccagtggagctgacaatttaatgacacattctaaaaccctattcgtttttagccgtggtccatgcaccgttgtgcagctcatgcatatgtgttgtacgggtgcaaggcggaatagtgtttatcggcttagtcaaagacccaccagccgatccgatgatgttcttggctgctatgaagggagagcaagggacagaaaaagaacgagagagagagggcgagagaaagagagatgcgtgaggtaccgaatgccaagcccgagagccgagctgagatattaatgaaagactgcacatgtggcgtgtgagttagctgtacaagtatcgtgtgtaccgatacacttgtgcctggcccgaagtaactaccagtagctacaagactcatacaagcaagatacagtacatactgtacgtacaaatatcgctatgtgctcatatattggcatgttcaacatacgggtgtgcgaggtcgccgggttcgattacacaagatacaatagggttcctactgagcaggttcagtccaaaggccgccttttcccttctttccccctccttttttgattctagggaacggtgccgccatggctgtcagatagcagtgaggcaaggagacagatgggctgacagagttaagttgcatgtgccgatagctaccgaaagtctggctgatgcgccagcagcaaagtctatcggtgcggataaactgcggatgtgacaatcggtgattcgtaatccgaatgtgggtctcactaaatagggtgctgttcgcccagagggcatcgggggcagtagtccgaatgtgccgatgtatttgatacaagtaatcgtatctgcaatgagcatgtgacagtaaattgacagtaattttgctgcgtaggatcggcttggcagagcaaattacgtagacagacagacagacaaacagacagacaaacaagcattatatttgtattgatctccaagcatcagaggataaacaaaagtttgttacaacagcagagtatcgtagctactgggacttgtagcctagtgatggaagcaggtggcggtctttcgaggcaagatttgtcatggtgcgtgggcgtgattgtgggcattgccaaactacatccgaccattaccagaaaaccagcctgatgacttctttcttcagacttccttgacttcacatcactgtctacaaatacgataatacgatagctactgtaccatcaaaacagaccacccttgttgccagcatcaaaccccacactactcttcttggcgcggcctgtcgaagtgaccagaacaaggcccggagcgcggtgtcggagctgtgagagcggaactcggatcccggatcccaactttcacgcgatagagcgacccaaacgaacaccccgagcacggcaataatttgtgacgcgggtgcgatgcatgctccaggcacggaacggataccagaattttttatagagccgaaggtgcaggtaataattagacctctagccgacgataatacaggctaacggtgggggaggagtagggatgatattatggctgtaccaagacgtgtgcaggcgctacagtagtatcatatattgtcgtggatactggtaggggtattgtgccgccattgtaccattcttcatacggtacatacataggagcctccagtacaatacatcccaggaccaaaatctgtgatgagtacaaccattcttaagcaagtgatatgtcgaaattgaatcagacagtatctgaatcacctacagtaccttgcacgatagctccctccgtgtacttgtacctgaattagcttggatctatattagtgtgaggctaacatctccaggatcgagtggagaagtagccaagttgtaatacagagggccctacgaaacgcctagtggatcggggagatttttttttgacctggacgatgctggtgtaaaggagagcacaaattttctcaaaaacagtccattcgcccgcttgaagtccatcatggcaagtactggaacacgaaaatgctcaattgattacaatacagtcgactaatagcgatgtgacataccagtcacgggggccttcactaacgtacctgtcactgttgcattgaagcagccaccgaacggcaccagcaacaactcaattggtatctacattgtagtcaccaggctccatggtccatttttcgttgctttcaccacaccttaatcagtggcgttggtattggaaaagatgtgcacggtggagatgtaaggattgtcacgataaagtgatactctaattatactgtacttgtatatgggtgagagggtccagttggaattgcgaacagtggttcaaaagaggctgaagtgggaacaggagaatgccgcgaccgagagaattcgattgaatgagatatctcttacaaaagtagtgttccccgtacctcatttgtattgaccatcaccttccatttctcgctctcccctgaccttatcattagccttcctctaaaagtgggtgccagtatgtactcgtccgtgcctactatagcaataaggtgttactatattacggtaaagccctcatttctattaacatgacattcatttggcgttgtggcgacgttggggcgacgaagtaggcaggactttcgtctaccattaccaatcaatgtctgcacatgtatatttccaaatacaatgcctttacaagcagggtctcgtgccgaatctcattgttggcttccatgaaaatatcggaactaatacttgtactcgtaccagctgcactccctactcgtagtcatcgcgtacaactgcccaaacggctccacgtgactgtcccaaacaggaacaacgactccaactctaagcagcgtgcaccagcagacagacagagttttgccactcggagcaagtcggaatggagaatggtggagaggtgtttggggcgtgaaaagcgaccgaatcgagctcggaatcagtgaaaagcgtctccaaccaccagatttcatccccaaacaaccaccagccttccttcacgtccattacaatacatactcactcattggctccagccacaggttctgcaaggcccacatggcaactttatttgaaagcaaacagagtgcattggaaaaaaaggtggcgcaacttttttcaaccggtgtggctaatacacatggtgcacttcaaacagagttgcgaattgtggctgttacctacagtagttctggggtaactggagaatgagcaatatcatgatcatgaacctcatcgggggcatgcgatcgatctgataatctgacagagccaatcacatgacctgatcgtcttcagaaattgtattttctgctgacattttataagctacagataccggctccaatacaactacagttctcttctacgatagttgccagcgaaatgggacaatagtggtttgaactttggaaaatgacggaaacatatctgtcatttccaatgactaattacatctccattcgagtctagaatatctgatctttcacctcacatgtctgaaacattgctacttgctggtatagtccatagttgcgctctcattctccagaccaccaaatagacgtcttgtgagtagggactgcagacccacaaaaaagatccagacaaactctgtcgtctgtaattactcctacttgtacagttctgtaacaagcgcaccttttcactttgctggtcttcccttgtctctttcttgatccaaatcacctcgttataattacagtatgtacaggctttggaataggaggagactcaactcagagctcgacgcgcgttcaaaagcccagttcctccttaaactggttcggcaccaatcacgtaccgaataactgccattgccgccgcggcgcgcgtatactggtcattagaccgagaaatgcttcggaactaaccactaccatatagacttctgttttgcatcatgtacctttgctccgaagggtccctacgatactagccacttccgccacaaaccgtatatggacgtcggtagaacggaggaggctataataacggttgaaaacggactggattatgtcaagtcctttttaagcttccacaattgtccctaagtgcacaaagttacacttttctcccagatatttctcccatccgcctccaccccggatacactagccacataacttagccacaataaccgcgttgctgtcaaactctaaaactaagcatgcacgaaaatgtggctggagcaaaggggtctagaccgcgtattgctgggctgggaacaggtcgcgaggggctgctaattgacccaattgaaacgcgcgaaaacaattgttttctgaccgacctctcaccgctccctcgctccactagctctgttttgccactaaatctgcaagtcatccgctcgccaccgacctggccggagtttgcccgctagactcaaacaaagttaaggtttcaatctctccggaaagaccggctcagtcataaccattcaagctctttatatacaaaccagctggccaggagataggaggatcatcttcgatgttgatttgataaaaagtgagtattgccgttgcgacgtgatttggggcccagcgttggtttgggacggaattcacattcttctctcaggtgtctcaatcacgccatttgggccatgagggagttttcggacatgtggaggaagtcataaaacgtgggttcgagaaggaaacggaggtcgaaatgtgatgatgtgtgataatgggacccttgttacgtgttctcaattgctggggacgataacaaggcgttttacacatttggcatggaacatgttagacctcccgctagagacctcgatctatcagagtctagatctaccagtctacctcaaactactggtgaagttctgtccggatgttgtccactcgagtcctaccgcgtctagttcccgtgcctctctctaatgtgtactaactcagtggtgttcaaatcgttttcccgaacctcgcacctggcgcgaaacctgttttcgtcgacaggtagcacgtaccacaaccagcagaaccagcccggattctttgtgtccacttctacgctccacagacacaactcgcagctagtatgttaccccccaggaccttcctacaaccccaacaacgacggacacagtgcagccaacctgctgccaccacacactgcctgtctctcggcagtaaccgtcaaccacaataatgcatcacagctggttagtgacgaggagagcttaggcgaggactcgcgacttaacctgcgacgacgtcagacgctcaccaagcccgcaccggtcgtctacagacgtatccagcccgcgtcttcgacccctcccacgaaggtggtcacagtgcattcttccgaacagctcacaaaacgacgactggccaccaacgccacttcctccgactacaactccctgtatgagtcgcttcgatcgttacaggtgagcgaaacggtggccaagagcgtcactcctccctcttctcctagaatcacacccatcgaagacactgtggatgtggatactctggagatgcccgaactaatgtctgacagctcgtccgtggcgtctgagactagcgtcgacgtcaagcctccagttctacccatcagacgacctggtgacgtccagttcctcccgcccattggcatctcttctgtcgatgattgtgctattctcgatacccctcctgcatccccccttgctaagacagcggaggccgttctcacgccaacctctgcttcagagtcacgtctcaatactctagatgacttcaactccgagctcgtgacgctgtcgaaacaggccaagtcctctgactctatcgggggcgtcgagcaagcagtctccgatgtcctgtctctataccaagacctgctcacaaagcacaaacccacagtcgacacatacacacaggtgattttgtgtctcaccacacaggccatgaagctggaaaagtggctcaagtctcccaagtacacccagtccaaggagacgctgcaggcagtcgacactgacaagcagcgggcccaacagctgtccaaggagtttgctattctggctgccgagatcttcttttcctcaaacgccgtaaccatgcagaagtactccgccggtatttacgagactttgctcaagtctggtagccacgttctgccttctcaacacgtcatccatgttgttgaggctcttgagcgtgttggcatgactcccactctgtcctgttacatgtctctgatggaccatttctccgctcataaggactacgagtccatgactgctgtctacaactcgttcaaggccacccttggctcgtctgtctcgtccaataaccttggcaagatatactccaagtttgttgttggaatgtacctgtgtggcgagtctgctgctgcccgagagttttgcgagtctgtcactggcgataacgagcttattcgaacagttttctcggctgctgtggagggcctggctgcaaccggtcaggtggaggaagcctggaccatggtgcagcggtttcagctcgacaatggcgtttctgtctctatcgaggcttcttcaaagcttctctcggctgtttctcaaaaagtttacaacatgactctgaagaagggtatgctttctatcgctcatgacgtttatctctactgcgcttctcacaagggtttcaccggccctcccacatcctccttctaccagtcggctgctcgatccgagtacattgacgtcatgatgaactcttgcaacctcgaagctctcagcgaggtggccgaggagctatacgttactgctactgccctggatgcttccactctgacccgatttactgccttcttcgtgaacatgcaccacaccaagtttgctctgcgattcctgtgttcccagcttgaggttgcccaattttccgagaccgttaccaccgaggttgtcaacaccatttttggcgtggtgatgcgaaagggcaaggagcttgatgcgcaagagctcgcctctctggtgaccgctttctctcacatttctatttccgagtcttcgtttgcctccctagtttctctccttaacatgtgctggtctcgaccctcgcccatatcttctctcctcgagaagtcagtgacacctctgaagtgcctggagcagtttgcctgtctgcacatgctgtggatcaagaccgcttcgaagaccaccaacgtgactgttgtggacgagctcaaggcccgatttggagctatcgttgatgctctgatgagccaatcgtgtgtgtttaaccaggtatttgtctctgacattgagaccaccctcaatgtgctcggtatggagactggtctattttccaagcgacaggagcaaattcaagctaaggttgaggtttccgaggctatccccactcctcctgcctctcctccttctctagagattgaccaggttctttctcgaaaggtcatcgcctttgctcgatccaaggctccgtccatcccccaggctctcaagactcttggcgatgctgttgctgcaggctccgttctttctgtcgaggccttcctctccgtcattgagggtgcctcttctaaggacacaatcaggggcgcttatgccgctgcaatggattctgtgccccatccttccacttctgctgcagcctggcagcactggaagcccatccaccgggcagtaattgtctctggtgctgctgttgaccgccactctgcgtctcaggcttaccagagtctcatcgccatgggctctcatccttgtgccacaggatacggacacctgattctgaaccgtgtcccccttcccaccaacactcacgacgaggctcaggacgccgtggctctgtttgaggaggccgtttcccacactcagcccaccaccttcctgttcaacatcgtgctgtccaagctgtccaaggcgcgtcgatttgactctgccatgaacattttctctgccatggacaagttccctgccaagaagacttccgttacctatggcaccatgatcagtgcttgctgccgtgctggtaacgtgggtgacgccgagcgtctgtttgaggagatggagctggaccccagctacgtcgctcgagccgctccctacaacaccatgaaccagtactacattcacactgcccgtgacgctgctgccgccaagcgaacctttgctcgaatgcaagaaaagggcgtgcagcctaccgcgcatactttcaagctgctgatcgatctgcacacctgttgcagcattaatattgctgctgccgactcagtgctgcacatgatcgaggcctgtggccagcaggtgaccgagcaccatctttcctctctgctgtacgcccgaggcgtgatcatgcaagatttccctgccgcgaaggccttctacaagaacatctgcacttcccgtgctgtccgtcctggaactgctatcttccaggcactcattgagtcctacgtggccaaccagcggtgccacgagactcctgaggtgttggagcagatgtcgcgatttggtgtcccccttaccgcgtacatgaccaactcgttaatccgaggctgggctgctcaggactttggaaaggcccttggcctgtttgatgccgcctaccgaaacggcaaggctgagccttcgtcatacgaggcaatcattcgagcctgtatctacaatggtgagctgcagaccgccagcaacattctggcaatgatgcaggccgcctcgtaccctcagcctgtggtcgccaaggtgcatgctcttctggagcgtgtcgagcaggcgcaggttgacggctggtcttatctcatgcacaataccttcaagtcggagactattagaatctagatgctagtgttactactaggccactagtgcaacgttcggttgtatttatttattaatatattaattagacatttttatgattttgtagattttagagactgaatgtgtgctgctaaactgaacttgataaataagtatagtctacaataacagctaccagtacgagtgcagtatgtacactgtacctatacgtgaacctaatgcacagcctcattattgtccagttcgaggatctacaagaattttcgcacctagttgttacttatatccaagtacaatagggagcctacatgccagttaatcatataatacattatccaattatcttgccattctcacctcctgggctcgtgcaatcagacttttgagatctcggactcccttatttacagggtctagagccgatttcggctgacactgcgaagacatgctgacatccgagagcatgctgacgtccggagacccaccctgtaggctggtgcgagatgactttcgcaccaaatgacccaatcgtctatccaactcctcctgcttctttcgctccttgagcatattttggtgacgttgagcagcaagagacatttcttgcatgtgctggagccgctctcgacgctgctgttggcgcctggaggcttcagactgtcccaagtcggacaaagaagcattaaaatgacgacaaagctcgtccatctgcgactcgaggttctgcgactccttatccgagggtcgacagatggtaaagaaggccaactcatcacgatacagcaactcagttatctgagagtcgacctcaacaccccagtaaacaaccacaacagccaacttgtaccaggactgggctcctacgtaggccagaagctcatcaaaggcttgtatttcaccggcagtcacatgattcgcatcaataccacactcgaacagaatgccaaaggtggacttgtagttgccattctccaccagtgaagtcaccatcatgctggtagtgtcggccgccttggccacatgctcgtatccactggtgtcctggccgttccaagacaaatcaaacttggtacggagccatttaccctgaagtcggtcccattgaggtgtgtagatgataatctgaggcatggaatcaaggcaggtattgctatgaaaaccagtcgacaaactcttgagtaaagagtcatactccagtggtttccacagcttgatggttccctgtttagttttctgaagcaactcgatgtgttcagcttcagactttgggcctgttcggattcgcttagacgaaccgacgacactcgaagaaccacaagatccaactctggaacgcatctttcgcttgccaaggttccgcatcacgtgattatactcctgttgacgtcgcacaagctccattttcctttgccacgaactgaatgcagttttctgcacctgagtcagagctctggagagagtgagccgacgactgttgactgctgcaaaagagtccagaaccacaaagtaagtgttttcacgtacaaaggctctgtagatctcttccgagagcgtggaaatcagtctagcccgctcctctcttgcctgctgttcccgctgacgtctctcagcctcgagctgggcatgtctctgcagctccaagcgccgttgttcctcaagacgtttctgctcagccaaacgttgttgttcctccaagcgacgctgctgagctagcttctgctgctcaatctgcgtgattgtggcggtacagatctgtttactcaaggtagaagcgacatccacaatcagcttggacgtaatctgctgagtccacctcttcttttcttctgcagatacctgaggcttagtcggggcaacaggtgcggctgcttgaactacccgtggcttaactggggccataaacggcacagaaggaggtttagagggcgccaagggtgcctggaaagtcgcagacgctgttcctggtggtccgaaaacaccccgcaagtctcctcccttctgtgtcacccactcgtgacaaatatcagcaaatggagtaagacctgccacagttgtctcgttgaagctaggtacgtccacagctccattagttacagtgagcttgtaatgaacaaaaaactcctgtgcctgagcagcgtcgtcaaagcccaaaacctggctcagctgctcgaggctgtaaggtctgccctttgaatgaaaggctcgagacatggttctcaatgcactgagtcgaacctgtgtgaaatgcgactcaagcatacacgtgactaaaaacgaaaagcgcggcagcttcagagcgtcgaaaaactgcgcatacaacgcctggcaatcctccatatgcatacctactccctgacgtcttcctcctcccacaaggttaccctgttgaatgatctcacgcaaatagagagcatcttggacgtgttggttgtcaaacacgtgtctaggtagactctggatttgcctgactacgtcagcttctcgcaaatgcgacagaagatggtacgcgtggaactcagcttcgtttttgagacattcagagtgcggatcacgtgccctatgagctttgtacatctccataagcgactgtagtgccttgttaagctgctccaactcctgctgttttgagtattcgtgtccagacatgaaatgcaggcagtagatatggatacgaacaatctgctcattacaccaaacagcctcggggcctgaatagttctgataagtaaaatcctgtcgaatggatcgcgttcggtcccataggaaagggtgagcaccaggtagctggggcacaatctcattcacaaggtagttcaatgtgttgactagaatgttaggaggacgaacgtcagatggaagtggtggtggctgaccggcagcaggtcttgaaaatgcctttactgcccggtctggagtcaccacgccgttggaatccttttcgtaagccttgacgttgttttcaaatcgtcgtcgaactcgttcaaatgcaggacacatttgttgacatgatcccacgaacgaaatggcttccgatagagctcgtctcttgtccggcgagtccacgaggttcagggactccattttcgttctttccacccctcgcatctgttgtaacgtttcgtactgttcctggtctccatttcctgtagcttcgatctgctgcacttcttgttggttctgtaggtcccaaggatgtgcctggaccactatcgggtcgagaatatgtggatttggtatcatccagggcttagttcgagcgtggctgttgtctcgagcattattggcgaatcctagagctgctgggttctgttgttgggaagattggacttgtgcgttgtgaacgaagctgctgatcgatttggcgtaattttgcgccggtgctggcgatgctgccttttgtttccgttgttttgcttgcttgctacctcctgttcctcctcctggttgcttcttgttgtttcctcctgcaagcttgggttgttggaaatgattaacctgagaaaatgccttattctggccaaacgccgaaatctgtgcaggctgtgaattttccggctgggtctgcggtccattctggaaatgggttgtgtttaaaaacgctgtcgatggagcggaaaatgcaaaacctcccgtagattgagtagtggtgttgttgttaggccgactaaacgggttagaagccggtgcggcgggttgtacttgaccaaagctcgattgtccaaacgaagacggcgatgctgttggtgcaccaaacgccggggtctggttctgtgtctgattctgttgctgcagggactggaacggatttgcggctccgtttccgttactctgaggaaacccgtttggggctccaaatggaatacctccgccactgttcatccacgacatgctggacgaagtgggagagtgtgttgtgggttgatagaagagagcggatgggaggtggtacttatggctggtatatgtgaaccgatgcacaacatggtgatgctgatgcaattaaggttggaggtggacttggagaatcaaaggggtgatgaaagcggtacatcgacgtcagtagagggtgcagaaatgaatagttggttccacatacactttaggcatgttacccatagcttgaatggaacgaatccaactattattgaagtaattatacatcatgggaacgctggagatttttacttgagcttagcttagttgggtcaaagtcaacactgtagatacaatgagcaagtagctaccctaacagtacatctacgagttactataagcacttctagacagactcactggaagaaaggaaagttcgatgctagcggcaaagtcatatagaacattggtttctcttcattacgaattcttcattagtcagcagtttttgagctcgagatgggatgaaacaggaacatcgtaacaggaacatcgtatgtactcgtaagtaccatacatacagtacagtatgctatacaatgagttcaacgtcaatgtactgtaatctcacaagaataaacagttcatagacaaacattaacgatagctattttcgtcgtaatcacagtatttgtgaatgtatggtctattgtaccacttccaacagtaaggtctctgcactgtgtactccaagttcttatcagcgttacgtattacagtcatttagtcgatattatctggttcttcagaaagaaatatgggagcttctgggtgaaaattatgttggaagttgcatctaaattagtctcagtttatttccaattttcaattattgtcaatctcaaaaatacccccgattattactttaaacttcccgcccgcataaagcagtctaatggcgataaattgccaatcgcataaacaccaaacacctcaaccaggacactactcgtacgacacccaatgacagataatgctgcaagaagaaatcgattcgcttgtctccaagttctctaacttggattcctcgctcattacagctattgctctggactgcgcttcagttgaggaggccgagtcgatgttagagcctctcaacaatgagtcagcaggagcagaccaggtctgtgaagattctacggactttctttcccacgacggaaccgactccacggggaacaccactgctcagacgtcggtggacgactacaaggaggcccagagactgcaactgattgaaaattaccatggggaccatgatcgtatgagacaggaggaaacacagacccagtcgcttcgcaaggagatcgaagacaccgatctcgatctggatacgtacatgacgattcgacgcatgttccctcacgtaccagctatcaagatcaaactcaggatgaaaaagtttagagacgcgtcagtggaggatctgttggaatacttcctaaactacgacactttgaaggaggtggctccagagcagtttggagcaaatgtggaggtgcttactatggtaacaaacaacaaacggaaactcagatcacgtgcccagggagattcgaatcgtgtgaaacgaggtgctgccctggtacaacttacccctctcagacgagttccttactgggatgacaatggcgagtatgatgatccgggcgactctcaatgctggaagatgttcaatggtgaaattgagaggatctcttcgcttctggatcttcctaaacagaaggtagcaaagtactactatgcatcaaatgttagcatcgccaagaccatcattgcaatcttagccgaagctcacgctgacgagatgaccgacgaggacaaggagtacgtgtatttaagcactgaccggttcaagaacgtgccatttgtgtatctggaacggttgtacttgtttgtcaatagagatgaggctaagtacagcgaggcagctggcattattgctgcctatgatgacaaatggaacgacatgttcagtttccggttcggtggaagcgagactacagagtccagaccgattgctgaggccactactgctcatgtgattacgcatcaaactcctacaagcactggaaacgaaaaggtgacgattgctttgactgctcctgcgcccagagtggatgaggaggaggttcggggtcccattactgatgctgatggttaccaacaagtttctggacgtcggtctgctcgtttaaagactgtcagtgagctccaggagcttgcccaacggctggaagagacccgaaagtcgtacatgtacaaatctacgacaaacccgactctcagaggatactacagaggtgcgattgctgagcttgaagagaaacgacgacaggctagcactgaagctcggttgctgcagcagcggcgtactgagagtgtctacttcaccgacttgcatgggctgaccgtcaatgaagccatgactcttgtgaccgacaagattgatgtttggtgggatgttgagcggatcaatttcgagaagcaggcgccagtgaagatgttgcatatcgttactggagcaggtaaccattcccataacggtgttcctaagatcaagaactccctcagcatgtggttgaagagtcacgggtggagttttcatagcaatactgcttcactagacgttattggaaggaggaaaaccagggcctgagctgttgattgggatatatgtttggttgattggaaaatgtgagttggtgtcgtcaatgttgatgtagacgaagtacagtacatactgtacatacgggaactcatagccactgcaactaaagtcaacctatacaaatcagaaaaacgctccaaacaaggatgaataagaatggtgacgcggatgaatgtatattagacagtaatgaaatgacattatgattttggaagtgataggttctttattgcaatgtgagaaatttagacaatttttctcaaaggggttgttggatatgttggatgtactgacttatacttgtagttcgccaaccaccaaactttgaggcggataaatgtttaggtcgcatatgtacccttctacaagtagtagattggaaagaaagtcggacaagggcacttatactgtatataatatgacagaaggcctcactacagtagagtgccagatttgactgacacgaactgttccacgtcccactatcgtgaatactacaactttaattccattacagttgatgtgaagaaaatcttacagtcacatgtgcttggtgtgatattttatatattgtatgatgacgccagatatgcgtttagtcaggcttccaatttctcactgttgcttctgtttctcctcagaactcttcctacgcactttatatactatcaaacacgaagtctgcctccagttagctagcgcaatcttaatctgcactccaacatcacgacgcgtcttactcgatatctccataacaacacaacatgttgaaacgagaacggggaaagacacctttttcgataggcgacggtctcaccggccgacggactggtgtaacagttgaggataccggagaacgggacgaaaatggaatggaaaagatcgacaatatataccaggaatcggctgacgaagactccgaagaggaaaagcctctcaagggaagtcatgccatgagtgatttcaaggtacagcgagacgacagtgacgatgagcaagcgagtcacgtgagcctacctcctcagacgcttactcggcccccaaagaccaaaattcaagctatcgggcttaacgatgtgacacaacgggctaccaatcagttaccaaaacagacaacaaaacagacaacaacaccagctagaggaactaccctcaaagccccatcatctgcccgtagactgaaaattgtatcggcggtgcctgtttccaaagtggtttctaaacccagtacatcctccaaggcttcttctttcgattcgaaaccagcaacacagtcttcctctacagcaccaaagatcaccaaagtgtcggcaatcaagtcgattcagcccgtgcctgctcagaaactaccagcaccacaaccaaaacagcgacaaccatcgcctgatgatactgttgactcactagacatgtctccggcaccatacaacaacccatacgtggcccctcccaccaagtttgtacccaagacgttttctagcacaaaaccattcacagcaaccgactcggttttcaagacgcctgctcgagccaacagtctctatggcgactcccctgcggactcgacgccaggagttcctacaccagccttcaagcctgcccagttcaatcctggaacattccagtttggaggagcaaaggacgtgtttgatatccctgaggatgaaccaataaatatgggcatggatatagacatgggcatggatatgagcatggatatggatgtgcatgacgaaagtattggatattccagccccaagaatgaaatcaagggagttagacctgcggatgttttcaattctccaaacgttcccaattcgagagactccagaggaagccttttcggctctcctgatgtgcctaaacctctacccaagcctaaggcaaaatcgaaagagcctaagaagaagccagccaaggagagaaagccgagctttgccgaaaagtataaacccagggacttctccaaagccaacgacgacctcttcaagccgttcaaggtcccctccaagacggtgtcttcaaaaaccgtcacttccaagccggcttctcgtgttgaagatgattccatagaagctatgagtgataacgactcgaatgctatggacttcactagcatcgttaagcacagtggccctggaagttttgtcaatggcaagtcatccaagtctaaggatactaagacgcacaagccgaacacttctgttgattctcttgactttgatcttagtggaactgatgacattggtggcggtgactacgacatttctatgggtggtgatgacgacgtggctacaaacggtggcaatggctcgttaggtgaggacgattctatttcatcaactcccaggcatttcgatcgctcaatcaactaccgggagatctctactgtcgatgactccaggatggactatgaggaggactctgacgacgactactatgaccagtcgtacagaatggaggatgatggggatgatgatgatgatgatgatgatgatgacgaatacaactctgctgtggacgaaaccatgaatcatggcagaggtgttcttccttctcctccccgttctctccgacgtcatcgaccgaaacgaaatgtaggacgtccggtgaggtattggatgggagagggaatccagtacaagttggaaaaaagcgaagctggaggatttgtgcctgttgtcaagagtgttactaggttgcctgataatgaagaggcagcagagagaacgaaacgcaagagaagaaaggcctatgatgttgacgatgctattgcagaggctgatgccgatgcgaacgaaaataccaacgataataatggcgtcgttactaattggcagaagaaaaaatcagttgaagttgaggttttcaactacaccgctgaagaaggtgatcctgaaacgcacatggaaaccgtggcttatagtcacgatggatgtgattacactgatcccagtcctgaaggtctttctgtggcccagttgtttggcgacaagaaagatttcactcaatctggcatggttcgtctgattggaggaggccgcaaacccgaacgaaactcccgccatcacttgcaccacttttatgtgctttcaggcattgtagatgtcactattggcgagaaggtgattcgaatcaaggctgggtgtccctttattattcctagaggtaccatgtttgcgttgcagaacgcttctgaaaccattgaggcgctactcttctatgtccgatcccatgatactcttctgaggtacgaggagagagttgcacaagcagagatggatggggtgaatgagacaggagaaggtgagggtgttcaggactgaaactatttataactaactgtatttttaatatgactcaaccaatggcaattgggcgtactgtatagctttgtacaactatctatacattgcatcgtacttgtatcttgaggcatgtatacacgcatgagtcctttccactcagccgcaaacttcactactgttattcgtatatacatctatctagatttcatcatcaaactcctcagggaagtctccgacttcgacggcctggggcttgacgaagcttccaaacttggccttgcactggaagtatctcttgcccttgacacttccatcgttctttcccagaggctcgtccagttccacgccaatccatggcgccccagagtcggttatttcgggaatctcgccaatatatcgcaccactccgcgtttactgccgttgatctcacatcggagtccgagcttaatacccttggcctcaatggcctcttcagcttcgaccacagctttgtcgagacggtctttggcattaggatcgaatctgccaagctggttctttcgcttccagtccagcacagtgtcggacttgctctcatattccgtctggggcatctgataccggctgtccacatcctcctgccctccgccgaccagctcggccacggagatctttccagacgtgtcggtcacgtgcaatcgggctagatgctgagggttgaacgactcaagcgtcttggaccccgaaatagaggcgtctgaggcgtccgggttgtagatgactgtgggctgaggtcccccatagagagtgagcttttgagatgtaggagagattccggtgacggattcgagtttctgggtaatctcaacgagggtgagattggggtcaagccgtcgctcgccagaagtggcgtcgctggtgataaatagagaaatgtcgggcatgttgtggtttgataaggggctgattaggtttgcatgggtctgattatcaacaaaattcaacaaatgtgtggtggcgcatatttcgtgatgaacagaccaaacagcaaatactcattattatagtacatactgtacgtacaagaagggtataaaaattgatatcatccgaatttaactaaagataccatgctattgcttccctgaagtagctgcaggatgggttttgtgagcctggtgcgtgcagtactgtccaccgctttacgagtagtcaaatgaactttatctatttttccaactaaatgtctgataaatacaccagaaatactagatacaattgcagtagttaacgagctaccataagtggacagccacaactttcatcgtacgggaacacacaagaggcacccataacatggcatattacaaagattttcttctggcccacaatatgttcaatgcttaccaatacagtactaatacagtacttgtagctactaaaactacaatgcgaaactactgtattcaccctcacagctctggccggtccactactttttttttttttttctgcataaacattcatttaattataactttgctgtgaaagaataacctttgaaatgaatgtacgcttacacgaatattactaattaaacacgtttagtgtcatggtccaacttggcacgtacctatttccagtaaaaaaatcataaaaaaacctggttcagtccgtgttgtatgttggtccacatagcttcgcgtgtttgttcgttcatcgggaaaacgccactccagtctccagttctctaatctcaatccttccattgccctcttcgtttgcattgcctttgaaaacgtctccttgtggttcttcttcgtcattggtttggttctgcgtcccctgtggtgactacgcgccctgctacgctgttctctcggtggcctcggccgccttttacgcttgctacttcttattgccaccctaacgattaacctacaagtgcagtatcactgactatcattaccagggcttttactgttcacacccacactacagttcaggttatcccctcatatagctatacccctgacctgtcaataaacaacatgacctatcgttcctattttaataatacgtatgtcttatttctatttacaaaaaaaaaaaagaatataaaaaacttatgcacaagatgcacgctttctctctctcacacacacacttggtactcccgtttgttcacactgtgcacgcagcacagaagacaccaccccacaaatacagttcatgttagcatcaccaccaaataaatgcaccgtgacaaacgccagcgaatgtcggactcaattcccagccaaaaagaccgcaagtacgaccgtcagctacgactatgggccgcatcgggccaacgtgcactcgaagatgcgtccgtgtgtcttctgggctcgtctccagtcgccacggaaaccatgaagaacctgattctgcccaatgtcggctcctacaccgtggtggacggtggcaatgtgacagaggacgatctgtcggccaacttcttcttcgattcagattcaattggaaaaagcaaggctcaaagtgccagtctgttgcttaacgaactcaacaaagacagcacaggctcatatctggaccagaagcccagcaaaatcgtagcatccaacctctcctactttgaccagttcagcattatcgttgcctctgtttcttctttcgacaagtactcggatctcgaggccctttcggagtacctctactcacactacatcccacttgtggtgatctcttcggcgggattttacggctacgtgcgagtggtaatgaaggagctccccatcattgatacacatccggactcgctggtagatttgagattggatagcccctggcctgagctgatggagtacgtcaacaacttcccagagcccgaaacggcagcagcacgagatcatgtccccatgattgttttattgctcaagacggctgataagtggatcaaggaacatgagggaggtcttcccactaagcgagacgagaaactggcattcaaaaaacaggtggaagcattacgtcagggagacagcgaaaacgtggacgaagcagtggccgcagtatggagactgtaccaaaagagcaaccaggtgccatcacagatccgggacctttttaatttatctgctgaagactctacagatagagatccgaccttctggactctggttgaagccctcaaggactttgtggctgagacgggtacttttcccctgtccggaaccgtccccgatttcaaggcatacaccaaagactacgttgatatccagcgtgtgtataaggacaaggcaaacaaagacctgtccaggttcaaggagattgtggctacaaaggtggtggaagttcctgagactgtgattgaggagttcagcaagaactctcgattcatccatctagctcgaggaacgtctctaacccatgacatcagtcccgagagtctagcccagatcacttctgaggatgatgatcttctgaaactctactacgtcattcgagccagccagatgctggggggtaaacaggacgcgttttcgataatgaccaagactaacgagctgggagttactgctgacgtagtggaatactctcaggaggtcgctcgatacgagggccgagagcttcataacatttctagtgttattggaggggtggcgtctcaggagattgtcaaaattctggctaagcaatatgttccgttgaacaacactgtgctcttcgacggcattggcagtaagatggagaagtggttgttgtaggtctgcgacatatagattaattggatagggtgggggtatgtggatcaatctagaaatgtacctcatcaggagaccctggaatagtctgtttctaccagcgacaagatcagacagttgatcatggactctgctgtctcatatcatattcccgatacgggcacctttgtatcactcgaacaacaaagaacttgattacacagcagaacgtgtgtattaaatttcccctcccctaccagtgtaatcagcaaactgtgaactgtggatatggcatccgaggtgcaggatctcactcttcaacccgaccagtaaaaagcggttgcatttcaatggggttacggagcaggttatcgacggctttattggacgttgcactcaagggtctgccagatggagcataccctccaagccagctatccaaggtgcggaagtacgaaaacttcgactctaaaattccgtgcaaggacgacgacgtgatcgagatacattcattgattttggcaagccaaatggtccttctttcttttttatttctcaatatactgtatttgattaactacaacatcattcaagagaataattttggtatcgaatgcaagcaaaacggggttcattggcaacatgatggacaatcatatgagcgagaagagctccaagagttactttactgtaggctacccgatcaagtgggtcgaagccatcgttttgtatccctacaaagagaagatacacttgaattccctacagccaacgacgttattatcgttactcaaatgtacgatatacctgaacttttcacccaggccatgagacgaatcaagcttgaagatatatggatgtccatcatgttatcaacacatggcggaaggtgaaaccacacaactgagcagtcggtgactactgagcagctcctgtcaaacagaagatggccaagttgcataactcatccgacgccctgaacgaacttagtaagctggaactctgagagctgcaacctgtcctttatggcaagacccgaaatgagggaaaggccaaaaagaacaaaaaccccaactccaccaaaaccaacgacagtaacattagaagataatgggagtttcgtgtttgtatcaataaaataatatattaacatcagtagtgtgaacttcatctttctttctgtctctctcttcctgtctctctctgtctgacagtctctctgtttcgtccccatatatacctatattctttgtaccagcgtctcccccccttctaccttggtgagtccccgatccgacggactctaggctcaccatccgttgattgtcaccgcaccatgggcaccttacctttgagctcttccttgctgaccttgtagaaccagtccttctcctcgttgtactcgtacatagcccaatccacaccgtaaggcttgggctcaagacagtagagagtgtggagaggaatgtcgaggtccccaatggcacttcttccgagattcatgaagtaggccaacaggacacgagacacaactcgatgaccgataatcagagcatggtcatgcattcgttccagctcacagataattggtcgaagtcgagaaatgacatctagatacgactcacctccaggtccagggtaccggtattgcaccttgtccttcatacggttctcgtactcatgaggatacgtggccttgatttctgcgtacgtcattccgtcacagatacccgctccaagctcattcagcatacgcatctccttgacatcgtaatgttcctcgtcaaaaaaggaggctgtttgtacagttcgacatagcattgatgtccaaacacaaaagttggcctgtgaagtgttaggagcagacgtattcgcacatgtggcaggtgaacaagtggcgcagttttcttccagtgaacaggtagtgctatctgtaggggcagacttggccatactgtcattggactcgctcgatttggccgaatcagtggattccttgcgatcagtaagattcacagtcgaatgattgacactatctgaggtcagagtaaccacaggtacatcgcaaggtggcggagtaggctcgaaaggttcatccaagcctcctgcgctggtgtcatcaatggcagcagacttggcttccgcatcctcaggtttgtcataaacactgggcattccatcccccaccagtttcttgatttcggcgatgttctccttaaatacctgctcatccaaatgagcggacgtgtcagcgtctcctgactcggtctggggatagatagttgacgaccctcgtctctgcagttcctccagattgagcttctctcgctgtcgtctgtcaaactctcctctctggtagtccatgaatcgaaccaaagccttagaaaatttgattccacgaggagtcagttccgagtcgcccccaattcgacccaagacattgtcctgagactctccatgtcgggtgatccagatctgacgttccagaaggttgaaattgaacaggaaaaagaccacctgtccagccaagaaaccctgaatgttgaaacataccacctttcgaccaacgtcgatcatcttgacgtactgaaagccctgcatatccttctcctcgctgtcctccacagtctgatatgccttttcgtaatttcgcagacgtccggtaaagtcctccagagcagtctgagggtccatgtccttgtaatcaggccccgacagcttcagtcggatgttgctgtttatgatatcgatgtctgtacagaccgattcaaggaacagcaccttcaattgacccttggattgctgttgaatcttctcaaacacattctttcgccgatctcgggtcgtgtttgtggcatccaggatacccacagatccatttccatgcagaacatagtccaaacattgttggagagtctccattgcccagatttctcgttgggcagtgctctgggggttgtcgggcgagaagaaggatgcatcatgagaagtttcgttgtggtgctcttcgttggggtcttctactcctgcacttcccaccgcggcctccttggcttctcgtcgagtgttacccacgttgaagatccgcgttttgtgttgctgccagttgagataccggcacagcttgtttgtaatgtacgatttgccccgtgctggcagtcccaccatgaccactatcagcttggatcccacatctctggaactgatcataccatcgggagacaccttggatcttgtctgtcccggcacgtccaacgtcgttgctcgtggtttccgtttgtggcccgtgtaatcgggaatgtgtagggtcgaagatgagtgctgtaggaccggttttgtcggatgcgtctgcacctctgctggagaggcactaagaaacgcagattggggtgtatgtgttgggctgaagtcactggttggtgcccggcttgtgtcgctgactgtagtgccactggcaccttgtagcatggacagaatgctgctttctctgagcttgacgaccggccgcttctcaatcgtcagatagtcctccccggacgcgctgagatctagctgtggtggcgtctgtggtggcgtcttgtcctcggccatgaggggcgtgtcacttggtggacgtcgttggaagtgcttgaaagaagggtgtctcatgatagacggggctggtgccgaagaagcagcattactgtgtgtttgagatgagctgggggtacgtgtaggctgcttaaacgaggggaataccggcgagccatcttccggggtggtcgcgttgtcgctcatgttttgtggcaagagtttggtgcggtgttgtacttgtctagttacgaggttgggatggcgaaggagtgggttttagggtgtggtgatagctgtcatgcagccaaaaagttagcttgttgtatggatggattataagcaccacgccgtttgaagagaagaacagagttcaaccagaagtatggcagggccgttgtttgttggtttaaccagttggtcatttgacgggcatccgattttgtaaaacttgtagtcctcaaccatgcccatagtgctactgttgtttgcatactacaccacatcacctgcaccactcgtaactgcggataaacaagacggttatgatgctgtctattgacgccgctgcaagtcggaaaaacatggcacataggcacagttggcgcacgtgaatttttggcggggtctcgggaatcgatatttcgggccgttagctagcgcccagggttattttggccgctgtggacacgtagaccggcgaggtttgggctacacctttcccccctttccgttctatctatactgtattttcggtggtcgtattgagtcctaattttttacagccttcctttaaaaaaatcctgtacagattttccgggcccaagtttattggcgaaagattatccgacgcacgtgggtccgattgttggcgtaagaccagtgggtcaggcgaagtttcggtgcatttcaagcacgtcaggaaaaacaaatggggccagcaaggcgaaaaaggaagacggggacgtaaaaacaaaatcggtttcacctggaaatagatatcgcctaactctacaagtagctaccgtgaccataaccaaaacagactagcacacacggcatgttcaaatggccatacaaacagactaaaaggggccaatcagtgggttagttgtggtcagcccattggaccatcactccccctggtgaccgctcacagagagagtggtgggtttttttgcaaaagtagcatctcagccgcattaattaattggagatcctgtgagccaaatcgattaatgcactcatcgtggccgcggtgcgtgccacaagcactactgatagagacagtttgggtgagaaaaagacaacactttgagagggagccagaaagagggggttggccgacatcccttcgcggtcggcctcaatgagaccacgggcctcatttcccgtacgccaccctccaacacatgactgcttgaaaacatgtttcagtttgtttggtcaggcccaacgaacctctttgtccaagattcaaacaacggttgtgcactcgtaaggcacatccaggcacagtgtgccggtagtgccgtgccgtgtcgtgaagaagttgagcatattatatcgtctgacgcctgaacatagtgtctgattgtaccaagccacttcagccatttattcattatctcgtcatcggctattgaacggttattgacagggggcgagagggttatccacctcctccacagctcaacaagtttatatcatatgaactctacaaaaacacgaaacgctgtattgtacgaacgagtatcgtacacttctactatcaatgaatgataccctttcagtaaaacgagtcggatctcaccttcatgccaactgttttcatacgtcaaaatgaaaggcacttatggacaaggtggaagtacgagatttaggtgacttctgtagatccaatatttgcaatacacgagacactgtaggtgcgttaaaagctcgttttccgtaatggattaccatgtctccacattcagagttgctactatttgtagtcatctttcctattaatcagtcctactcgctgcctggagaaagtaatctgcattgtcaggacgttcaagtatattaattatcctattaattatcaacccctactcgtaaccacacataggtatttactacagcgtcggacatcactcacttctacagctgtggctatacgaatggtttcaatttgacatcgccatagccaaaaacctatacaaacctgtgcctgtcacctaccatatgtacaggtagctctctctctctctctagtgcagtattatgcagctggcacgacaaaaactaccgatgtccatactgtatcatagttgctacaaatagttgtgggtcttcctctgttttatgtacggattaccatctatcctctttgatacataattcattagtaaagtcagttatatagccaacaaaatgctgccgggtgtttacgtcgatacgccaccatccaatgctccagttgctcagtttgacctctaagggccgtacagcgacccctcgacattgtccagaagcgagtactgtcgaatcaggtcacactcgccgcccttctccagatcgagagtgtactggtaaaaataaccttccagagtcaccaccagcacctgaggagggttggtggaagtgacactgaccaccgaacgggttccggggagcgacgtttgtttgatgaatgcaaaatctcgaagcggctcccacattccagtgaaggtctggggcaggtatgaaccaacagctcctgccagaccctttccaaggcttcgagacgacttccgaaacaccgaagccatacccttctgttgtggggtacgtgtgggaatagccagctccgtgtcctggggcacctcgggagtgctggacacgcccgcttcgagctggaagatatggactgtttctgtggcagaggaaacagccatgagattggaggccagattaaagttgatagagaagatctgggccgggtaggtgcctcgacggaactcgtagagcttctgggccttgggaacgctgaacactcggatgattgtacccttgtcggaggctgtagccagtagtgtaccgtcagagttcaatgacaggcatgccaagggagtcttgtgtgcctcgacgacgttcacgggctgaagagagttgcaatcgaagatggttacatcaccctttctattgggagatgagtcgttgatattgttttcgcctggattgaatgcagtggacgaaggagctgggaaagggtacaccaggtagttgttgttgtcggaagaggaagctgacagggcgcagacggctccagggttggggcttgtctcgattgtgtgcaccagtttcatgttgctaatgtcgtagatgtagatttgatcctgcaggagcaccaccagacgttgtcggttgagacgtacccctagaacagcagtgggaaacgtgagctcgcagatggtcgactgtcgttttgtgttgacgattttgagtcggcgaggagagttttgtggttggtcgcccatccccacaacggctattaacgaggtacaaaagagcatctccacaatgcccatgcctccgtcggccttggagaagcatttgccgaacgggtcgcagttgtagattttgtagccctgaggggtgccgacagacacacaactgtagtcctggttgaaggacacaaagttgatcgagtcggacatgataaggagagtgtgggttgctgtgttgagtgttggtgatgatgagcccgtaggtgtagtaattaacttgcatatttgggagtgcatgagcttatcgggatggactggttggttgattggaccgagcgtcaattagaggtgtattaattgaagttcgaggtcaatagaagtagaagaacaacgtgtggtgcagatcgggtctcatttcggtatatatttgttgtttcttgttccattggtgtgcgtgcaatgagtagatacggggtcatactgatccggtggcaacagacatgaagtataagtaccgcttctgatcggtctgaataattcttataggattacttttgttaattatactgctcagtttattttcatccttttattccattcatctgatctctcagattcactgccgccttctcttgcaaccttgtacctgaccttccagttatcgccaccaggcaagttaatgtcaggtgatgctactgcatcaagaggagtggcatgcacctatgagacgaacagtgagagtgatggtaatgaacttatgaaatggtgaggtgaaacgcgtaacatcaaatcgtaaccatttgtactacaagtgggtgcttctggcctttgaaagaggagtattgatggcggtgtgtattagaacgtgggacatttcattcaatcaaaacgtcaagtgtaatctggctcatgataatattcaatgatatgtgacataatgagtcccagacagtggaattgaggcttctccaaagacaattagatacttgtgctggacaatatcaaggacaagtatctcccatgcaatttctacatatttaaacctgataactgatttacaattcacagacatgtctacaagtatatacctagtgattacatgactattactcatgcagttaattttctgacacaacgagacattagacccatgcaaagcaatcagattagacacaatttttgggaggaaatttattgtcttgtatcatacgtgaggtcgtacctctggcatactgttaattattcgtatgcttccaaatacctgctatggagaagtacaggctactacatactgtactctctactgcactgtacactctactgcactcgcattcttagccaaatctacactattaacattgcaactgtaggattgcattagagctggttgaaggcgtctcgggagacgattcgaccagttcgagcagcatggtgccattcggcgggggatcggggtcggtcctcggatcggatgatggatccaacggacatgaacagaccaaaagtagcagcggagccagccacgtactgtccgagggtcttcatgacaccgttggggccagctccatgggtgaagatggcgtagcctccaaacatgagaccagtgcagcatccgacggcggtcttggttagtaggatacaaacgggggagacgagtcgaaggtcaggagcggacagcgttcatgacagttaccagtcgaggaatctttgatgacgtggccaaagttgcttaaaatgtagtcactcgccatgtgctagatccggtgaataggctgtgcttcgcattgtagtttaaccgaaacggaaaaacacaagatggcgaatgaaaggaaactcaagatcgaacaagacgcaatggcgattgcggagtttcagacgatgttgcatccttatctcttttgctgacgtggcattcatttgttgtcctccatattgtcagcttcactcatttcatcaacccagtcaatcactccggtccaaatatcagtccactcaaatggctgtttgccagcaattaatactcactcccatcaaaagacccatcttgaacttctcaaagttggagggaccctgctggccctggaaaacagatggtggtggtgggggcatagttctttctggcttgtcttggtgtggaagaaacgtaaaaaaggtggtttcggcttttgctgttaaaaaaacctaacttagtgggtgtcaaaaaacgtgcatgatgtgggggacccaatggtcttatttgttgaatttagttggtgtttctcttgaaaatatagcaaacctaaaaatcaatcaaagtaaatgatgaacaaaattcgagccaagtaacaccacacgttgtgcctgtgttaggcaccacttacgtaaattgtggcaaaaaccacaggtatctgtagtcattacaggtatcaacaagcataagaacgcagatgtcgaattttacactacggcagactacaatctagcggaatactatctagcagaaaacacatactctgcataccctccattggcataattattcgcatgcactcgtgtgtgacctacggtgcctcttctctcaatccatcccatgtattaactatgcacgctaatcgaaaaagtcatcatcgtcgtcgtccaactctctccgattgatgatgatcttgttgttgccggtagtcttctggtcctgcttactaatctgacccagcaaactcaccagttcctcctcctcgaccttctttcggatctggccagtctgagccagtcttatcagcatgtcttcaacctgccgagctctgtcttgtcgcacgattcggatccgcgagagtcgttctcgtgcgttggctgtgagaatttgtgagagctgggttagtatgggtagtgagtggccatatgtaacgaacggacaccaaaaacacagttaactgaataacaagtgtaactaatagttgttcagagacgaccagatgttgcgatagctcgtgtggccatcccaagcttctcttggtaccacacgtcctgcctctgatcttccagaatgttcgaaaatacgctcttatacagagcgtgtcaggcattctcataagccctccaactctccaccacttttagaatgcattctgaacactcctcatcatactcacaatagcaactcgaccttcatcctcagctcctcctgcccctccggcacctcctggtcgtcctcccatctgaggcatgccctgccctcctccgggagctcctccttggctcttctgcagctcggccattcgagcctgtctgatggcttccaactcgtcgttatccatggtgcttttgtgtctgtagttgtgttactgtaaagtgtgaaacccttacgagctgcttgaatgatgcctgtgcatgtttcgaatatttcagtgccctaaccctgaatcaatcatatcactagaccaagctacctgcaccttggaatatggctgattaggttcggctatctaacgcacggcatcaatccctccccacacacttatttcctaccacgagaaaaacatgaaggtactgatcacgggcttcaatccattcgataacgacacagtcaacccgtcctatgaggctgttaagaaactgcctgatgagatctacgtcaacgaccagttgggtaccgtgacggtgatcaaggttgagattcccacggaattcaacacttcggcaaaggttgtgcgagacttggtggagctatacaagcccgcacacgtgatatgtgtgggtcaggccgggggacgttcgggaatcacccctgagagggtggccatcaatctggatgatgcttctatccctgataatgctggctacagacccgttgacgagcccatcattgccaatggaaagaactgctacttttcgtccttgcctgtcaagcaaattgtcagagagatttcgaaatcagggatgcccgctggtgtcagtgatactgctggcacgtttgtttgcaaccatgtcatgtaccacgtgtgctatatgaaggagtctggcgtgttcccctttctaaaatcatccggtttcattcacgttccgttttgttccgaccaggttgaacgtgatcacccctggtggaatcctctctcgtggatctacacacctccaagcatgtctctggaagacatgagtgccggcttggccattgctattaaggaggtggtcaagggagaatcaggagacaagattgagggaggagctatttgttaaaaccattaaaatttcattaaattattcatgtgccattgttggagtccggatatgggctttggggggagccacgggagcgtaagcacaaggctcgttatatcttgggggcatgtcttcagtttctgtggttccagatctaataggaccggaaatcatttgatgaaaaggaacgacactgggcgttctgtgtgacgtcacaaaacgttggagcgattgctcgtcctgagtccatgtagggaaaggagggttcgctgtctgggttgtagcccgctgcaactgtacgcgacgtccaatgactgcgagtaggatgaggaggaaagttgtaatgataaagcatatcgctgtagacgcgttggccatggttattgataattgtcaaaaggtagaggcgggcatcgtttggagatgacataacagcccatccatccctaatctatgttgaacgtagcgaggcatacatttggacgaaatagctgaatatctatgggcagggatgaaccaacagtcaatgtgaatatggaacttgaatgtcgtctaccgcttctgttactggctatgtacatattgtagtggtagctacaagatcctaaaagcatagtccaaagttacagtatcatgattacttgtacttgcatggagaaacaagcatagaaacaatgtggagttttcggagcccttcaattagatcactgaagtatatgctcctccattaaatggagaaaccttcgttatggcccatctaccagtatgttgctctcgtggataagtcaacaacgaggggtcaggtacagctcttgaatactaaccaacaattactgtagctcattgtgctggcgggaaactgaaactagtgtgcactatctcgacaacttcgtcattgttaagacgaatgtcgctcattaggttccaagtcgttacaggtttctccaaatctagatgattttatcgaacgataattgctttccaacatgtgctctatcgtattccacagaagtgataccgcgggaattacgagtcacaggcctgtcgtattctcatctggaaactcttcactcaacaactcaattgtgagacagtgtatctcagggtgaagacggtccgaactgagatggcgagtcaagattttgaacaagggaaaccctgttaagcaggaacaacacaattttttggtcaaactacagaaaccaagttcagtatctgctccaaccaagtggtttcgtttacatcaggtcgctcatactaacccatgcaagcacaagctctggcttaggtacacgagccacaagtgtcgtacgatgatttcctataatttagctgaagaaatcaccgactaaaagtggagtgttacccttcactatagtgtgtaccaaaaatttgaagcagccaatctttctcaagtctctcaagtcaccttcctcttggtatcagatcaggaacctgcgagaaaaggtcatctgttgtatcaggtttgaaacagtttcagataggatattctttggttgagaaccatgttgctgtcgagacctactgatgaaaatactggcaaaattctctgggcttatcgttccttgtccgaataccaaccccaacagtctggtatagattgaaaactggtgatttattatagctagaagaatctctacaaccaggcaaatttgctctttcgttttttgtggtcattacataaaaataattctgttatataccgacccattccgagcttttccgttctattatcgcggtgaaagtgaagttaaagacgcttcccgactccagcattaaagaagtggggaaatgggaggggtacagcaacggacctattgtagatgtagctttgaaagttgatatactgattcctatgggtcttttcgtctgtttaagcactttgaagtcaaccacaccccctttcaaatcagcctgccacataccgcctcgtatttttatgtaccccgcttgaaagtctgattagtcgagaatgtcagaaacaagctaattgtagtggagtcaaaaaagactacttgtagacactacagtagatagatagaagactagaggtcaattggagatagtacatacttcttagacgacggcactatagtactcctgttctgctcaatttgttttctttttgttctcactctgttcttgtaaacttttgtggccaactatcgtacgttctgtcaattcagtccccttcagatgaatacttgttcgtgattaccgtaaatacacttttgttgtccccctttttttattctactgttgtcttattccgcctgtggcacgagaactacgatactgtatctggaatgtctctccacccccaccatacatatccatggcgtagccgaaagtgatagatgcaagggaattacgacaaaggaaggtatgtacatactcatgaattttcagtggcttcgatcttagcgtgcgaacatgattgtctagagtgctaccaaggggttgagccttggaggattcgacttgggtgtatgtaggggctcattctatctcaattttcaaaatctctctacgttctctctctatatcatgttgtcatcccgtagtctttttcatacgatacgatacttgacataacctcggatgtacatatatcacaccctgccacaggatgagcttgtctcacattgcaagtacatacgaattaattagtgcgtctgtactgtaccttggacggagcgtcccacttctccgataatgcatgatgattattcgggttttgaaggtggtgttgataatctcataggactactatttgaaagcaactgaatgtatgtgattattctcgtgtgtatagactacatccctcgtacattagctaccccaaccacaccttttttatcccctcggaggtcccttatttgccttcacttttccagcatcccctttgccctcctacttgtaggttagactctctcgaccccacctcccaacagcccgaataatgtgcttaaagatggtgtctgaaacctaactgtgaagccggtcaggagataataaatagtccaatggatccactcagagatcctggaaaacacattctaaccctcaaaatgacacagaaacaggttctatcacacgtggcaatcgccctcgggctggcagccgagatcgcacactttctgacccttcttcacaacactaccagcgacctccgaggagcgacttggatgcaactggcgtacaagctaacctttgtggctgccgactggctatttgttttatttcccgccattatttttgtggttgttgccgccagagacgccgaagaccatgtgacccgcaagctctactttgccgccggagctgtcgcctcggccactcttctctacacgaacctcttgggaggagctacttatatcgttttctttggaggggctgctttgactctgatgctaagcgagtggagccgacgtgaaaagtccttgtacgagatgcaacaggacagacttccttttcagtgattgggtgactgttgcccgacacctgacctcattacctatttattcaataaaatgcatcccaaactagtagtctaactaagatcaagtattgaaaacgcgtacttcaaccaattctccaactggaagctccacaaaagtcaatactttgatacaaccttaagtgcaattttacctagaactacggcacaagacacgtcaaaagacatcatatacagacacattttgagaataatttgttgattattgtttcaggtacacatccgtacttcttctaagaccttttcatactggtaacatcccgccaacaccttctttaggacaccaccaaatcgccactaacgccactagaacctaaagcatgaaactctaaaaatttcatgtacattatctttaattcacttgggtagaaaatctcttgatctgaacagtacaagatggcattcaaaaacatgaagaacttatctggcaagtcccggtttgcgcgtcccgtcaagcccaaggtccccggaccagcacgaacgttccatcccgtcttcaacggcaagaaattcccccataaggccccgctatacaacaccttccctcatgtggaacccaagccttgggaggccaaaaagatgtctcgagacgactactaccgagagctggccaggaagcgaaagttggacgaggatcaggccaagaaccgccttctgaacttgcagagaaagcagcagctgatccaggaaaagtatctcaacaacgacgagtacgatctgatcgaagaatctgacaagaagaagaagaatgctaccagcaaatccgatgatgagtttcttacccccgattctcttacagagctcgattataaacccaagaaggtgtacattgtcaagaaagacaaccctcgagagaaggaaggagcgattttcagaaacagacagacatatgataagcccaagcttgacgagcgattcttcggtcaggacgtattgtacggaacccacgccgttgaggcttgtctaaccagtcacaagcgtcgaaaccaatgtctgaagctgtttgttggagaaggaaagcttggcgagcctgttgtcaagaagatcatggatatggcgcgaaagctgcgaatccctacggagaatgtggaccgaaacactctcaatctgatcaccaagcatgctattcataacggtgttgctctggtgactaaacctcttgagctggacgagattcttgagctcgagcccttcacgaaggccaacattggtcagagcatctttgtcaagactatgcgacatggtgttgtgatctccgagcctgccagctacctatttagcgaagaggagcgaatgaactccctcgaggaggtcgagaagactgaggatgccactgaggagactgctgctgaggttgctgagattgtgaatgatgcttctgaggctgccaagaagaaggaccccgtcactgagaatatttccgaggtgaagcaggagatgaaggagacagttgatgaagtcaagctggctgttgagaagaccgctgaggaggctgaggagactgtttctgaggagaacaagcctgagcttactgctatcgctactgacagtgaagctgaagctattgctgatgctgattttgttacccagacttctgcctcctctgaatctcccattgaacatgaagaacttgagtctgaagagattgacatgtctcctatcactcccactttccaagtgacttcttccgtggagtcccaccgtcccagacgattccctctggttgtctaccttgatcagctgaatgatacccacaatctcggctcgattctgcgatcctgtcagttcctgggtgccgatgctgttatcgtgaccgccaagaactgtgctcctttgtctcctgctgtggccaagacttcctctggtgctctggaatacatgcccgtttttgagaacagcaagacccccgcccatttcttccagaagtgcaagaataatggctggaacattgtctgtgccgctgttcctaccgccagcggagctgccaagtccaaggctgataaacctctgtctctccgacagtgtggctcttggctggataacaagcccaccgttctcgttcttggaggagagcatggaggtgttcgacagacgattctcaaccaggctgaccaccacgtgattgtgcctgccagcaactcgtggatcaaaaacaacaccgtggactcgctcaacgtgggtgtggccgctggtattcttattaacagattcgtcgtaatctaagcgacgttatagaaaaggatggaaggcttgtatatagttaattaatgcattgatatggtgtggatttgatgtagtcgctgaaccaggttaggtcgatttatcgcagcatcttggttcacgccgtcaagtcagaagctcgacaaacagacccaggcaaaacattcactatccaactattttactcaagaagcgttatcaaaaattatgctgcaaatacggcaccgaaagacgagccgcatcaccaaatatccagaagtgaacactgctcctctcgtcacacatccggcttgcctttttttaacgctcttacgatgacgggatcctctttaggaaacctctgtacacaaggtggagacaacgcacatttttcaagcatcatgcccactcaatgcattgcgtgtataagaaagtactgtaataaggtgcatttaggggactaatagtacatgtacgggtacgactacacgtacagtacagtaatacaagtaatattttcttggctaacaaatttcttgattaacaaattgacaaagatttccagatccgtgaaccggtcaaacttaataaacttgccttttttggcattttgcaaatgtacgttcctacatgttttcccctatctcggactccgatgttcactgaaagggccgtgtggtgtgccgtacttttatccaaactctatcgcgctatcagtgccgcatctagacttggcgatggggtctgtaatggcagtagctgtgtagcgaaggaacaagctgcgtagtaaaacaggatttgttcccttcactcatctcctactcactttgaagctggctatggctgttgaccacgttcctcattgtcttttcggatattaaactcttctcgtgcatacggctgttagtggaattattgagagcccgtgtgggttgatcctgggatgttgagagagagcaaaagtggctctgatccgtcggtatgtacatttttatcataatccgtctttccgcatctcgatagcatatctataacgtgttctggtttgaatcgtcactgcgttcaccaatctctgtggcgttgcgttggaggttagcgcaaaccaacatcatactacttgtagtaggactataccataataaggattaatagtacgccgtttcaacgtaacacagctgttagataccagcatctaatgcaagacaaatatctgatccacaataagtaacgaagaccctcaaaaaacctacgacaacctgacacaaggaagatgaccaatgcaggtaaaagcacgagcctagtaggagtttattttgttgccgagatcattactttggctataacgagtgtgcacttttttgtaaaagaagaaaatgaacctatagtaactatttgttaccactttttagccgcttaatctactcttttcactcccagagacccatcctccttctggttattgaacatcaaaacaatcagtcatatcaacgctccccaaattctacgtcgttttaagttctctttcaatatataaaaaactctggcttggtccgtggagattctcaccatcataacggattcaatatgggtgccaaagacgaaacaatcagtccaacgacattctcaaacctgtctgattccagcaatactcgctcggggaccgacaacagccccgaaaatgacattatagacggggcacacgaaaaggatgccgcaactacagatgtaacaccggatacagatgcagtagcacgtcctacaggccctccaccgatctccaacgccaaaaagggtcttattgccggtctgctatctctttccgtgcttattgttgctctagatcagactattgtgactacatccctacccgacattgtggccgctctcaaatcgtcgtcaggatactcctgggtcggtgcagcatataccctggcgtgtgccggtgtgttgcctgcttacggtcgatttgcagatatctttggacgaaaaatcaccctcatggtggccattttactatttattttgggctcgggaatctgtggaggtgccagctcgatcaacatgttgattggaggcagagtggtgcagggactcggaggaggaggcatttcggcactagtcaacatcatcatctctgatatagtggcactgcatcaacgaggagcgttcatgggcatgttgggagccacctgggctattggaggagccattgggccgttgattggaggagctctaacccaaaatgtcagttggcggtggtgtttctacctgaacctacctattgccggcttcaccatgtgcatgctattccttctactgaagaacaacaagggtttggagtacgagaatgatactcgaactgtgtggcagaagctcttaaagattgacttctgtggtatcattcttgttgctggagccactgttttacttcttctggcccttgattggggaggaactacccacccttgggggtcaggcatcattatcgcctttctggtggttgccttcgtgctctacggcatctttcttactctggagtggtttcaggaccaacgggaaaactaccctcgaccaatcatgcctcccagcttgtttgccaacaagacccgacttggaggctacctctttaccttcttccactccattgttttcatgtgcatttcttacttcatgcccttcatgtaccagtccgtctacggcaagagccccatgggttcggcagtctacttgcttccacaggcctttgtcaccggtggactatctgctggagcaggtatcttcattgcaaaaacgggccattatctgcctgtcatgtggatctccagtgttattatcatcgtctttactggaatgctgagcactctggacgagacctccaacgttggcaagcgaatctgttacgtaatggcttggggtgctggtattggacctgttttccaggcacctctagtggtcattcacacccaggttgaacgtaagaacattgccattagtaccacaacctggagttttgtgcgtatgctgggcatgtccattggtatttccattggaggtgtggtgttccagaaccagatggaggaccagatcagtgacccggccatcatccggcagcttcccgagtggctcctggaacctctgtcgggaaccaatgctgctgctgctacccagatgctcaacaataaagggtcagatatcagtgcccatgtgctcagtctggtgcgatacatgtactcgcatgcattcaagtacgtcttttacacctgtctgggtctctgtggaggtttgttgagtgtgttgttgattggtaagcaccaggtcaagatgagaggcgatctgggcaagaaggaaaagcaggaaaagagagaagccgagaaccgggcgctgtcagaacagccgggagaatcagtttaaaattaatgaataatgactaatgactataaaacggaatatatctgtacgggtacttaggtgaataatcagatatggcgaggcatgcactgctgctacttacagtacactatgtacaggggtctgtgaaagcagaatatataaagaaggatttttgaacgaaataggcaacatcatgttaaagtagctaccgtactacttgtactacacaattaggaatgtctcaatatgagccattttaaccaatgtctacttgttcacacgttgatgaatctaattgaacacagtaaggatcatgaccagcatagaagacccagcatgagacacagacgcgattagcacacataatgcaaaggggagcgtccgaccagttacaaatcaattttaatattatagtacaacatacgaatttttgctctagacactgtttgatgctacatgcccttctgaggacccactttgactcgctgcttatgtaacttcccaacactaaacaaacttcgtccatggcgtttttgatcaactaagcgtatactcacgacatactgccaaatcccacacacccacacactacagacacgctatggtggaacaatacggaatcacggagccgatttccacggcgcccccgacgcccgaggagattgcgctcaacggtgagctcattgaggagcttaagcgacaaggatcattcgagagcgaggccgagtccaacaaacggaaaaaagtgctgttgatcatgcagcagttggcccaggagtacgtgcgacaagtgagtctcaagaagaacttttcggatggcatggcccgtgatgccggaggcaaaatcttcacgtttggatcttactctctgggagtccatggtccgggatctgatatcgatacgctgattgtggtccccaaacatgtgactcgagaagacttctttgaggtgttcgaacgtcttctccgagaacggcccgagttggaggagatctctgccgtacccgacgcctttgttcccatcatcaaggtcaagttcatgggtatctccatcgatttgatttcggcccgtctcgacatccccaaagtgccactagacctgacgttggaagacgacaacctgctgcgaaacgtggacgacaaggatctgcgagctctcaacggtacgcgagtgaccgacgacattctccgtctggttcccaacaagacggtgttcaagcatgccctacgagttatcaaaatctgggcacaaaaccgagcggtatacggaaacatcatgggtttccctggaggagtacagtggggaattctggtggcccgagtgtgtcaattatatcccaacgccgtggctgcagtgattttgtcgcgattcttcaacgtgcttttaagatggagatggccccagccagtactcctcaagaagattgaggatggcccattacaggcgcgagtgtggaacccccgaatctactcgcaggacaaattgcacaggatgcccatcatcacacctgcctacccttccatgtgcgccacccacaatatcaccgccagtacacaaaaggtcattttgcgagaacttgagagaggaggccagattctcaacgaaattatgctgggccagaagccgtggtcggcactgtttgaaaagcaccatttcttctcggactacaaatactatttatcgattgtggcggctagcaagggcacggcggaacagcagctcaagtggagcggttttgtcgaatccaaattacgacatcttgtgcagaagctcgaactgctggactctatcgagctggcccatccttacgtgaaaacgttcgacaaagagcatttgtgcaacagtgatgaagaggctctcaaggtggcagacggccagaacgtggcagcagtgactctgtcgactgacttggagaaggctgtggccgacgaggttggcgatgagaagtcaaaggacgaggctgatcgaaaagacaagatcattgtgtacactaccacattttacataggcttggacatcaagctggagaccaaagaaggaggcaaacgaagattggacatcctggcaccctgtcaagaattttatagaacttgtcgaagcttcaccgactacaacgaagatatgcacagcatcttcattgattctgtcaaagcgtgagtataccactaaccccaaaacagctaccaaaacccaactaacacagatacgatctccctgaagacgtgttcagacctgacgagacgcgaccagagaaacctagaaagaagagaaagagaaaggaggcccccaaggagggagtcaaacctgttcctgcggagtaggcgtattatacatatccatagggtcaaaatacattataacgacagcagtagaaatgaaaaacaactatataaaagaataaattgatcgtgttacatttcagttgtgagtggtattaacggttaatatacatttaatacattttatacagtttataggtgaatctacttctttcgcttagcatcaccagagggagcgtcagaagcccgcttttttgtgagaatgtcgtcagtaacgtatgtggtagtctcgggtagtcgcttgacaatgttatcaaggatttccagctctccttcaagcacgattgacgccatcttgtgcttgtgggtcttgtcagacttctcaccgtaggtctttttcttggactcgacgagttccgtcagggacttgacagcatcgtcgatgaggagaccctggttggacttcttccacaactgcttgacgacctgctttcgcagggacttgtcctgcttgagcttggacaacagagaggtgtccttggtgatgagctcgaggaaggaaataaagcacgcgagatcaaactcgatctcgccggtcttcccgaccacaaagtactcgtccataatctcgtactctccctgccagtcctctagaagatcggtggcctcctctatgaggtccttagaggccttgttagcgtaaaaatcggagatttcgtccatagagaactcgacaatatcaaactcagtgccctcgttctccacgtatccgtatcgtctcaggaagtcgcagttgggcagctcgccgtaagtgttgtatacctgctcacccttcttaatgggctgaatagcagtcatggagaaccctccatcgtcttcagcaatgaggttggcgttacagaaacgagtgtgggcgttaagggtgtcagccaggggaaccatagccttgacaagaccctcgttgtacagatcgtcatgctctatgtcctcatcgtcctcctcgtcctcagaaaagctatcgggagcatcaaaagagtaggccataatgagacctcccattctgtggaaagattcgagagaagtatcacagtccttgaagtactcgggatgggcatcaatgatgggcttcagcttttcctggtagtcctcctcagcgccagccttgccaatcttcttgactatcatggatcccttgagaccctcgagctcgtcgtcggtccacatcatgagagagtccagctgggtgggcaggacgtcaaagtagggcttccacttagtcatggagccagccttcatcatgtacagaatcaattgcagccacgagttgagtttcttggcctcggggacctgtttgatgaaatcggggtcattctcaaccgacagaaacgagcttcgggggatcttgaacagcacctcatcctcctctatgtcttcggatgcaatcactcctcgaccttggtggtcagatcggtagtcatgaatagcgattttcggtgagatttcgtacttgagatcaccggcgagaaagtcgctgaatgctttggagtcgttttcgaacgtgtctgtcattgttgaaggtgtctgtgttttggttaatgagtttgatttgatttttcagacagaaatacttctgggtaaacaaattaagctctcaaaaatatttcagagtttggactatgtagagggtggtattgttgtaataatgctggctggaaagaagagataagataagaagcagttgggatcaacttgctggtattttaaagctatttttcatatgtttatctcgcttagaactgtacatcttctcaatattctacagttctccaaatgtcacactgcagcgtcatgcatcaacggtgtcgactgattgtttgactatggaggtcgaaaaatacgaataaaaaaacatgttgaaaaatgttgtatttattttggttattggtggggtgtagttggttatcattcgctgtttgtgcttcattgatatatatactctcttgaaactctgacttcagctcatacttctgcttcaccgctagttctgatttccccagggggaatcgaactcacgccctcaagagaagacatctctaacttcccaaataagctcaaaaaaaactggattagcctttgtgcctatgcagatatgtaaatttttttgacatcttcttcatacacatctacacacaatgggaactggcaaaaaagaagctaccagacgagccaagggcggcgagaccggcaacggcttcggcaacatccgtgtcaagggtgtcaacttctatcgagatgccaagaaggtcaagaagctgagcatgtacaaggagggccgagccaagcacaatgcccgaggagaggaggtccaggccgccactttccagtccaaggaaatccccaacgctcgaatcgaccccaaccgacggtggttcggcaacactcgagtcattgcccaagacgctctcaatcacttccgagaggccctaggcgagaccaagcgagattcataccaggtgctgctgcgacaaaacaagctgcccatgtcgttattggaggagaacaacaagatcccccaagtgaaggtggtggagaccgagtcatacgctaacacttttggccccaaggcccagcggaagaagccccagctggctgttggagactttgccgagcttgcatctgctgccgacgagagccagcaggacttcgaggctaagaaggaggaggacaactcgtggaaggtggacggctggtcccaggaggccaaggaggccattttccacaagggtcagtccaagcgaatctggaatgagctgtacaaggttattgactcctcagatgtggttattcatgtgcttgacgcccgagaccctctaggaaccaggtgtacctccgtcgagcaatacatcaagaaggaggctccccacaagcatctcatctttgttctcaacaagtgtgatcttgtgcccacgtgggttgctgccgcttgggtcaagcatctttcgcaagactaccccactctggcctttcacgcctccatcaccaactctttcggtaagggttctctgatccagctgctgcgacagtactcggctctgcaccctgaccgacaacagatttccgtgggtttcatcggataccccaacaccggaaagtcatccatcatcaacactctgcgaaagaagaaggtctgcaagactgcccctatccccggagagacaaaggtgtggcagtacattactctgatgaagcgaatcttcctcattgactgtcccggtattgtgcctcccagtcagaaggactccgagacggacattcttttccgaggtgtcgtgcgagtcgagcatgtctcctaccccgagcagtacatccccgctcttctggagcgatgtgagaccaagcatctggagcgaacttacgaggtgtccggctggagtaacgccaccgagttcctggagaagattgcacgaaagcacggtcgtctgttgaagggaggagagcccgacgagtctggaatcgccaagctgattctcaacgacttcaaccgaggcaagatcccttggttcgtgccccctcctcaggccgaggacatggagaacgtcaagttcgccgctggagagggccgactgggagagatgaagaagcgagagatccacgaggcccctgctgctactgagactgccgaggagaccaaggaggaggagttcaagggttttgatgattaattgggctatttatagtaatagagatgcatgcttgtttgagtgggaaagtgtacagtcttgtagtatggctaagtagtgaggtgatacagagtacagtatgtacagtacttgtacaaatagttaatctactcgttttgtacaatacttagagatatgaatcattacttggtaccatgtgaggacttattcagcggcaagtgtgttaaatgcgccccctcgtcttccccgtttgtcgaagttcgactcctggtcagatcaggctgaaatataagctgtttggaccaccagttgtttcttaccggaagtctgaattctctgttcctcgtgtacagtataaccccgttttgcttgcagtcgatacaaagattattctcttaaaagatgttataattaaagtagtagtaagttgcgctgggggtacattttcacagttgcggacattgtgcagcaaaatgcggggatgaattgataactagaatgcatcgttttaacaggtatgcaatatcagccaatccaggttggtacaccgctattctgtattacagtaccaacatttctagaatctctgatatttgcgaaatcatgaagatgctgttattacagtacttcaagatttacttgacatttactcagcatagtatttttatccaaaagaaaaaattaggcataaatagcagaaaattaattccagataatgacttggtaaggcatcgaagcggtcaccgattcatagtaatctcataaaaatacctcctaacatcgttctcgcagccgtccatctcacacttaacctaaccctacaccgccttctccagacccattcaaactcaatcatcttcaactgcaacatggaccgccgtctacgtcctttgtttcccagcctgcgccgaggaatccaaactctggccactggtatcactcccgctcaacttccgacctactacaatgcctccaagccgtgtttactggacttctccagccttcacaagctgaaagccaacgagaaatgggccacagatggacgcatcaataacgagtacttcgagagcattataaccaaggatggcgtggatcctgccgttggggtagaaaagggacgcatggaccgagatgcagttgaatccggaggcgaaagcagcgactttcaacggtttgaaatgcctctcagtttcttcttgcagtgcatcaaccatgaagtgccccagtttcgagacctgtatctcgcccagacatacttaacggactcgcttccaagtctcaaggacgatctcagtcccaacccgttccttgagaacgcttctgttgaagcaattggattctggatcggtcgaaacaccttcacccctcctcattatgatcccagtggaaacatctatatgatggtgctgggaagcaaaaaggtgcgtctgtggaaacctcaggagaagaatccgcttggaaccgccaaactgggctccaatttcaatttccagactggcaagcccgactacgaggttactctggaaccaggtcaggttctgttcaccccccaagggtggttccatgaacttgagagcaagggactcagtgctgctgtcaactggtggttcagactgaatagctcgacctaagttaattgcatatagatttatagacccctggcacagcaactacgctatcgaactcatattaacgtctacgcgcccactctcaacgattaattaatgcatcaactacaaaggggatcttctaacgacggtcagggccttgggtccggcctcatggaatgtctctgcgagctcgccatccttatgcagagctcgcatctcgtctcctcctccaagagacttgccggccacaatcacattgggcacggttcctcgtccggtcttctgtttcacatatgcctgcagctccgggccgctggggtgcttatccagctcgacaatctgcaggtcgggcgtgatggcgtattccttttgcaacaggtccttgacaaactgcgaatgggggcagtatgacttggagaagacaatgactggtgccaacttgagaatcgactggtattccttctcggggttgaactcctcgccctgggacgtggtcaagtcggccttttcctcgcccttgacgattttttctgtcttttccttctcgctcttgtgggccactccctcatcctcgttgacctccagcacctccttgtcgatgttgttgtccgtagttttgacggttttttggctggacgaacgcgggtccacagccagatcgtatcgcggtccgtgaacggcgaagatcaaaagacccactgtgaagaggatggctgtaagaatgagaactcgggttcttctggtggagaccatgatggctgcaactaacgggtgaaaaaaataaaatgggatcgcttcagagtcgcgtggagagtcgggccgcttgtgtgccaaatttcaggtggtatttccgggtgtagggtgatgacgcggtgtcggttccactgaaagagatgctcaaatcagtgttctcgactcgctttcgtcgtgtcgatagatagatcaatccaaactaggtttgggattgcagaccaactgaaaggcgtgtcacaaaaagcttaagtgggataatggaatgtgcaagcatgggctatatacctactaataatggtatgttcggtggcgaaacggccctaacggggtggttgatcgttagaacgcgtagaaatattaccatttgtagcattcaagaccggtcggaactctcaccccattattggcaaacaaacagcaactggttaatctgtgcgtctggtgttgtgctgctgtgagctgctttttcctgtcgcctcttgcttgcccttcccacttttttcatttattcttcgccttcctcacaccggctacaaagcctaaagaggacgtcgtgggagacagattgacatggcccctgcatacgcatggcacgctttacaaggtggatggaatcagtgcgagtggagtgagaccgatggcaacaacggagcgaacaagtacaagtaccgattgtataaataagactgcagtgcgaaatccatcaccgtccacccacacccatgtcaacgcaaaaacgatgcctgcctttggacaaaagctgctacaggatccccttgtagttatgatacttagccagaatccacctgttagtctactgaatatcccctctctaaaacgatggcctagacagggcgaggtcattctacgttttagcgctcttcaagtttttcttagtttgtccaccatatcctctctctggtggtacttgtattaatgccgtatatttgacactatagaacacaactacagtacattcaatataactccatcggagtgctctatcaacgtttcctcggaacctacctgtatccctgatcagccttgtggaatctacatcatcctaatatcgtctctgcagctgggggtctcttcggacttctacgtctcttcggacttctacatcatacatgtggagtcagtctggacagcagcaacgagtcagagagctctaacgacgcgttctaagacgaccaaaaacaaataaataccaccgacgggtacgagttcttgtagctgagcatacctgcgttgcatatgattactgtttcactatcactgaatcataatccacctctgtgctatttttaacagatctgagccatggaactcaatcgccaattctgatagtccattccaacgaagattttaattaacccaagcaaactccggatgaagaaaagcaaacacaagcctattacagaattaatgacctatttttgtaactacaagtatgccccacctttcctatgacgtcatcgcaaatgtatgtgctgttagctataggtgtatgtacattcttcagaacgttcttgcaccaaaactgcatggaagagccgggtcgatcaacacgaataaaagtagtaggtcaggaatggaacaaggacaagccgttaaagagatctctgttcgagcatgtactgtaaccacaacccattagtaaaaagtctgctctacttaaacacctcatgacccttcactttgccgcttccaatctccatcttggcacttcgggctccaaattgaatggcgcgctttttctgaaaagttaccgaatcaagccccacactccgagccacctctcggagtagaaacttggtgtcttcatcacgtgatccgctcagcttgaggttcaccgggcaggccgttgcccaggcaaccacgtcttcgtccagaaacgggtatcgggcctcctttccatggtgacaaatgactctgtcgtctcggccgaggtttcggacatgcaaacgagaaaactcgacctgtagagactctgccacggcatcgtaaccacgtgtaagactctgcacgattctcgagtatcctccaaacaactcatctgctcctagtcctgaaattacaacgttgctggagcatgctttgctggcaaagtagaaggcgacagcaatactgagatccataactgacgtagaggggtacatcaacgactgaacagtctctcgatgagagagtgtctcctcgtaaggaacattgacttctgagaagatcatccgaccatattgactcagtgccttcaattcttcaaaggtgtttctacctaggacccgatctggagtctcgtactcttctccaactcgaggattttggaaagcaacgttaacgagctgaattgacactgacggaggcagattaatgtccgccaaccgtgcgagtaatgcacagtcaatacctcctgagaagagaattgatatttgctcatatcccaccgttctgaccgacaatgcatctgccaaaagctgtttgaactgagtggcatactctgagatcacgtgattttccagctcaatgacatcattcgacacttccctgtatggatatatcaagttcggattagtctcatcgtccttgtatccccatagatgctcacttatgctaactgtcacaacatcaagctcgtagactactccccccacacattggatccagccttgctcttcggtatccatcacatgatcggtcacagacgagatcacaaagttctcgccatcaatcctgtagactagggaccgtcttcctatgcaatctcttccaaaccagatggtgttgccgtcaacgaacgcaaatgcatattctcctttgatgttttgtaatgcagaaatgacgctcggggtgttgaagagcgcttccgaaaaagccaccgtgtcacatccctccccaatgttgtacaactcaccattgtacatgacaattttgtcgttcttgactactggctgaggtgtcagcggtggtctcaacgacagaactgacgataaacaatgaacctgtgagctggagacacgtgtatcgaagcaagttggaccacgtgacttgactcgattcaatagctcgtcgtctatcgttcccttccagcacagaatcccacacatgtcgttattagggtttctccccgttcgcgatggagatttttcaaatcatgcatgtattgtacatatttcatgcacatcgagattagatagtggctcatcacagtagcacaatacagaacgcgtcaactacattatactagccactacagtaccgtgcagtactgtagttattgtggtactcattaacaagctagaattttgaatacctcctgatctcacagtaacactgagacttgcaaaactgctgtttctcggtcgttattccagccatacagcgaaccaagccaccagtgacacaaacgcatcccccgccatccttgtcatcaatacagtatctgagcacctcatcactggacaatcctacacccatgtatgagccatcaaaacattccagattgatttgaacagcaagctcggaagtgagtgtcctgtagatgggctttcctttgggcctagtcttcttgggtgtgctttggctctggcttctaccacgtcttgttatctcgtctttgttttgaccgttcttctctgggctggtgaggattgtttgggtaaaatcaaagagtgtcgctttctgtatcacgtcgaaatgtcgatgaataatgctctgtgtctgatagaatgccgagaatgagtgctgagaaatgtaagaggccgctaccacaacaattaaaagatactgcgttagaacttgtagttgcatgtcgatagaaggtagaaaaccaggattacagtattggggacttataagggcttatggttgagttgtggtttcgacaatggtacagtacatatctttgaggcacagttattataaggagaggtctgttgacagtggcgcaacctcaaaggagcactggaggagccagaaagcgctgtattctatgtgagctctcatttaaccattatttatgttgctatatcacttcaattgcatatatattctgcgttaacacaagtcagacactcagaccgttggccccatgatgctttagccccattttagcgtctcacttgtggaagtttaagcgccgaagaaatcaaagaccggaactactcataacactgcaatacatacgtcatcaacaaaaaataactacaaccatgtcatgtctggacacgtgcaaatttctgtgcttctagcgacaatggttaccctacctacacaagtcccatagactgtattaaagagagtttctgtgcatacataactcccacattatcgagtttatcgaactttattcaacaacagtacacaagttgaaagcagtgtagtgcaaccctctggtaaatcaaaaattaacggcacaggcgacacatacggcacagccatccaaaaaaacactctcatttctcgtcgaatatcgccaaccactacaccatacatgttacctccagaagtgtggctcaacatctgctcgtatctcgacaccaactcattgcgtgccgtctcactcacctcatggatgctacatcagtgtgcgagtactcgattatggaattcgccaaccagacccttgcatgctgtacgtcatgtgatcccagcgggctgggcagcgacggaaaccaccacggaagttatcgatccaaattcgcctccgcctactccagagccaaccaaccctctgttttcagactatgaccgacgcagtgtcgggcttttgaataccctaaacaaaacccccgacattgagctgtattgtcgtcactttgttcgtcgtctgctgctggtgtacaattcgtcagacccctggtgcacgctggatagcgagtttggacatgccatgttgaccaataccaattttcaaacgctcaaggatttgaccatatgcatttttggaaacggttcaagcactgatcatcacctggttaaactccaagatgctttctttcagtggtgctacagagaagaaggaagaaacgtgcacatcacctgtaaaaacagcacgtttctgagcggagaaagcatcgataagtcggtatatctggccttgcattcagtccagctagctcgaatcagtaatgagggactgaatcaattgcttatgaacagcagtaatctcaaatacttgagtgtctgttcatcttcgataagttctctcaagatctgtctacgacacatgacaggattggaatatttggatatggatttgccactgttttcacgaattgtaggcattccagttggccttaagactctcaaaataacagggatcgacgagttacctacaagactactcaagctggttgagaacgtccatcgactatatctcgagattgagggactggaaacggagggtttctgtcagacgtctcttgagactgagtttgactttgttatggagtcagttcgagagttacacattgtcggtggcgtttctgacctggtcgttctaaaacttcttgatatcactcctcaggctcgagttttggttgttcgagatgctcagccgttatctgaccaagcgtgctttgagtcactgcattgcaagaaaaacctcgagatgatttcatggtcaactcaggaggagagtgttattatcaactgatgagatagggtctacttattaattaccacagtgggaggttctttggtgttcttctttcaatcagctagtcgagggaccagtcgttgaagtccagcgaaatgaaaatcatgttattttcaatgctcgttatatgggccccaggatcatctatcatggcaatgcctcgtgctatcatatcactcatctttaggggggaacatactaacagaaagagaatgctcagtggacgccgtcacaatctcgagctcaattgaagcactgttagagtaataggtggcttgaactatcagcactgagaaacaatctctagagtaattcctgatgtttggctaccacttggaccaaataaaatcggctcacaaataatcagatacaaatactgtagctactcgtgataaaaattgaaagataaaacataaacagataataatcactaaatagactagacgggtgtcgctagagcttgtactcaaagtaaggagatcgatcaccaagctgggcgaactcatcctcggacatgctgtcgtagtagccagaggcaagtcgctccttcttgagggtgttctgccgggtgtagaagattcgcagactaactagacacacgaagcccaggacgatgaagcccaggttgacggagtgtccgagtcggtactggggcttgtcctgcactcgataaatgttagtggagacggctccaagaaggttaccaataccgatctgcacggccatggccacggctcgcttgtacgatccagacacgttgttggagatccaagagataataccgggaatggcagggtagattccaaatgcggccaggtagcaaccaacatatgtagcagcagggtgggctgcggcagaaatggagatagccagaatgtaacccagcatcatgcaacacaagttgaaggcgacaaagatagatcgcttctgcagccggtcggagagccatgcctgcagcacaccccagcaggcagccacaatgtaaatggggatggtcagtagctgggccttggaggaggtgtagccgaggttcttgataatggagggcaggaagaaggagatggagtaaagaggacagataataccccagaagagtccgagatgcagccaggtctggatgtccttgaaggcgtcccagaggtacttggagttcatggagtcatcctgggccacagcggaggaggaagactggccgtcaaacttgattcggtacatgatgtactgtcgctcatcctcagtcaggaacttggcggtctcagggtaatcgtagagagtaaagtaggcaatgaatccaacaacaacggtggcgataccttcgaggatgaagatccatctccatccctcgagtccagcgacgcctcgcatcttggaaatggcgaaggcaagtagaccagaaaatgcaccagccacggaagcggcagagaagaacattgcctgtcggaactggagctcggatcggcagtaccaagttgtaagataatatgcgacaccagggaacagaccagcctcgaagacaccgagcaggactcgtgtagcgagaagacctccatagttctgaacaatgcccatcagagtcataaccagtccccaggcaaccatgatggaagggagccagatggagggtcggaacttcttgagcagcatgttagaggggacttcgaggggtgcataggtgaagaagaagacagtgagggccatgttgtactgctcaccggtgaggttgagatctgtagaaaggccctcgatgttagcgttaccaatgttacctcgatcgaggaaacacagaaggtagagaagagaaagcatggggatgatgtggaagtccatctttcgtagcagctttttcttgtctacgctggggtaaagctcctcagcggtcgccatgagctctcccgaggccttctcggggtcggtgatggtgatctgagtgccattcttgaaatcctcctcaatggaggcggattcaatgtgagtagcgtcggtcttctccatgctagtcggttgtagaattaaaaatgaaggggaagaaggtgttgaagtagttggagtggttggttggtttatcgaaggaaatcagtcaagcagtggatgcctatacaaactccaaagccgtcgtggttggagtagtagtggttgctagtgcaggcttgtagtgatttaccccagacgcccacgacaccttttatattaaaaacgccaaggtgtcgacatctgaaaagacgcacagttttgtggggtaacatgcgagatagcaaaagtcgagaccttctacgattgtcggtctctcatcggtaactgacttctttgtgcagatatgaggaatagagagacgtcagagggggatatgggtaaaccttagtgcgccaagctaacgaggggatgtcgtgcactacagcagggtggcaaagtcggtgaaatccgcgcactcggaaattatagggggtaaatgaacgcgtctttcagacttacctttggccttctcttctgcttttaacactgagttttccacgcaacgagatcccaacagagttaagcagtgtcgatatagtgtcgtgtccacaatttagcccttgacagccgcacatcagccgtgtatgtctcgttagtttagactagatttgacaaactcaaactcacaattgggttcctactgctcaatcagagcaattgggttcgctcttcgccttgaaaaaagtggggaaatgcattattatgacgattcaacggttttggagagcgcccacaacaggactttactgaccaattattatgagtatccagctaatcaacgacaaaatcaacctacaacagggtcgtatacctgtcgcaatattaaatcactactgcgaaaaagaaagaaagaaaagaaaaaaacacgctaaaacgagatgtgaaaaatgccacactaactcacatgcaaaggtcggggcaacggatccacattgtgtggctcgtgttacgctaacatctgacaagcatcgtctgacggggatcgatcagtgtctgcagctgctaatctcctgtgtggaagtgtgaactcacacactctcttgattcgcctagcttactgtattggtttcatttggccatgccggccggtttgcttgctccttaaaatggtgctggcaagttgaaccgaaaattccttatctgaactcaatctgagtgctagtttaaccgacttgtggagagcttgtgctgcattcgtgcatggctgtacgggaagatgcataatgaaggcatttgtgacagcacagctacagacacaatgtacagacgcgtaaaggtcgacatgcttatgtgggtagatgcactcgatacttgttgagcgcacagtgagtaccttgctaggctgtcaggtggggaaccttgtgcatattgcaagctcaacagccttcgatccacagtattctcaacgttaacagcaatcccaagtaatgaacacacaaatttagggtgcctgaacccctgtcgtcatctagacagtatcataataggtctctattattactgcttttgacaggtaatttaaagatcttatgacgtgtgtcaccgaatgtcattttgggtctgtctctacatctacccatcttcgcttagtatggccggattgagtataaggggtggagtaagatagcagaccctcctcaccaagcactctcacgaaaactcctccccctggatcgcacaccataatctctttccaccgtatagtcgtcatatcgcttgggtgcttaagccccactggaccctctgctgagctccgcatttcatgctatactttcctgttccggggtgtgtgttagcttggcaggctatcgatcaaccggcattactccggcctgtggctgcacgatgtttttgattgtgaacaaccaacgactaaatgtgtcaatgtttcacccaaagagagacgagacgtggtgtgaggtcaaaatatggcaaaacgagccacttgtatctgcttgttagtcatcactcacatcccactagccgtaaatatcccgggtagtgcaatattatcatcgtctgtctcattcatcggacccataattttcttgtttcgtcattgtgtatcgtaaggtaggccaccatttggccccaccatacagaagccgccgcacttcccctccttatatatatgaggggaaacgtttggtgtatcaggccatgtccgacgtcttggcgtttgtggaagaatcccaatatgcacataaagtagggttaactcagttttgcaccacaacgtcggtcagacctcgggggtataatctcgggcaaaattcggacggtaataggggtatcagaccactgggacgaatgtcagagattataatgtggccaccatggctgtatcgagaaatgttcctgttgagcatagattcgaacggcatgccgtgagctcactgttgatgatgctgtggcagaggcagatgaaacatgaatgtccgaggtctttacactcaagcatttgatgtaagggcttccatttattccagtacatgcctcttgggccgggagcacgtctgtcagtgtcggaatgtgatgttgtcaaatctgtctgtagtggatgcttgaatcgtcatagtcgtcgccgaagtcgtaataactaaccacctgtatcacaaataggtatcacagcggatatcatataatatctccctctgtggtgttgtctcttccatggaaaaagtcgtttgttgaagtgcagtggtgaacagatgtcgaacaatctactttcgatgtccaggttcaatgttggcgatgtggacatttgcgccgcgggggctcgtcctcagtgggtttcagtcgtattcccagccgtttctcttttccatcaattccctagcatcgacacactgaaatattggtctactgcccggattatatatatttaaacttgcgtgatactttcggaactagagatgccgtggatatgtcggctagggtcgacccggtcgatacccggatggggggtttgcggagggctgtaggagggactttgagacataatttgaccggacaaagcaatggatcaatattactgtgtccaatttgtagatttgtgtggttttaatttcgaaaataactctcgtacttgtaatagccctacccctcctattattccgcttccttaccgttagccttgagaaccttgttaagtatatgaaatgcagtgtgcgatacagaatgtgtatatgaattatggtggtgagttagtacaagatgacaattgtcgtacaggtacttgtatgggtacttgtaggtacgaatattgaatgagttgtgtataaaaggggttttgaatctcacctcgttctcattatacaagtccaagtacagtacttgtacttatctcgtgtctgttaattgtttgagtgggtcgtcttaaactccttaaactgacttcgtatgctgtgaagccacggtggggtgtgcaccctgcaagcgtaagaacggtcaatattctgagctgataacatgtgatctctatcacactatgtgtacaagtactctacaaagtacatgtactgtaccgacacaagaagatgagctcatactcacccgtccctctcaatgtgcacccccacacgctgcacacacagcgacaacaccagaatttcaagtacaagtacatggcgtcgaaggtgttaatttatcccctattcgagtccccgcaataactaccatgggtgtaccttcatatgagaaaaaaatatcgcctaagcgttcatattatgacggctactgatgctcatgtggggggaatactaagttcacgggtcatacatacctctcctaaaaatttgtacacatccacacacaaggttttgacgcgtgcatgatttcgttaatggaaaaaacgcgtcagggcagcacgaagctacacaacactcagcacactacaacatacgagctacaccaccatgccagcagtcctcccgataaagctgaatccatcgcaaatgcggcccgtggcgtaccggatcttctccaagaagcacggcctcaacttgaaatcaacaggtctcgaaacactcaccgaaatcataggcaaaaactacggaaccgaatggcgaggggccgaggctgccaaaatgatggaggagatttgtcgactgtggaaggagcaggagatgggtgtttttgtggagggcaagccgctgcaggaactgttcgatgagatcacagccagcaagaaggccaaggaaaaggcacgagtccaggtggtttccaagagcgtgggattgactggagtggaggaaatcgaggatcgggaaggagagccacaggtgaacgtcatcagagaagcagctccttctgtggacgttgtgtggaaggagttcttcaaggtgattagtgcttttgatcagcctcttttccattataatgcccgccagcaacggtttgagaagcggaaaacaaaacccacattgttcgccaatgcccaatctgcctctaacatgtttctgactcgttaccatctggtctacaaccgtctattgcgcaatgacgacaccacagacctgaaaatcacatcgatccgatctcttattggtcgacagggcgagttttccatcttcggaatgctttccaagaatccggagcagaagatttgtttgcaggacgacactggtcgtattctgctgatcctagcagctggttgcaagcctgatccaggagtatactatcctgaaggctcctttgtcatctgtaacggtcgatacatgaagtcaggagacgccgaagtgtttgtggtcatcaccatgggccctcctgtggccgagaaacgacaggagaccatcacagcatacggaaacatggactatctgggactgcatggaaacccccatggttctgtggtgagacgaattgaacggcaggtggaagcatcaatgcttgccgaagagaaacgcttggtagatcagaaagtgattgtgtttggtggagatatgtatttggacaatcctttgactctcaaggctctacagaaagtgttttcgaccattgagcttgagtttcaggactctggaaccaagaagcctctagccatggtgttctcaggagacttcactagtcagtaccagccaccgcatttgtacaaaaaggggttcgacaagttggaggagcttttcaaggagttcagcagcattatcactggtgtcaagattatttttgttcctggccaacgggatccttggactaacactttcccgacacagaatgcagttgttcctctgcaacctcttccaaccaccatgattaacagagtcgccagactatgtggagaggatgtttcaatgagctccaacccctgtagaatggcttatcttacacaggatatggtcttctaccgagatggactcagtgagcgtctgcgaaagtgcaaccttcaacttgattctgccaaggacgattcggacgattcggatgatgacattgagattgacaacgatgaagtaatgatcaacgacgttgtagtcaacgagcccgaatcgtccttcgactttggagaggggctcagcaacctcactcgaccagtggatatcagcactcctatggccagccaagtgggtcctaccaacactctttcagccaaggaggtggagtctcgcaagattgtgcgaaccatttgtgatcagggtcacttgtctcccttcaacagacacgacagacctgttgcctgggactacgacgaaactctatggctcagtccactgcctacgatcctgtttatggttgacacacatgctccgaagttctctctcaggtacgaggagtgtatggtggtcaaccctggccccttcctgaacagaaagatcgccagctgggttgagtatgatccttccaagaagacagtcaaggagcgacagttgcatatttagacagtaattcatgacccaatattagaaaaatgagcctttgttgcgtttgaagcgatattattgccttatcatacgcagtcttatgattattattagtaatcaaatgaagaatggagactaaaaaagcccgacgtggggcttgaacccacagccttgagatgacacctaagaataagagtctcacgctctaccgattgagctagccaggcatgtttaacgatattgaaaaaagaaaattggacgtagaataccgtacatttgattagtcagctgattagaataaaaaaattgagtaatgaatcatcagaataaaaaaaaattgagctgtaatgaatcattagttaaaaaaaatataaaaaagaaaaaacgagaaaagaaaaatggatcattaggataaacaaaaagtgtgtaatacatccaaagattaaaaataaaaaataaaaaataaaaaaacatcccagaaatcaaaaatgaaaaaccctgaaaatgtatttccgtagaacaaaataattaagatgtcctcagaacaaccataggagctctataacgacgcgttgcataaatagtagttgcataaagaaaaccaataacaacgagtaatactcatcaaagaatgcaggtaagataaacactgcgttcgcagagtacaatatgtacacacacaacctgacacgtcctgttgttacacattccagcaagatcagtttatgcatgcaacaatacatacaacacaatacatttaatcgtatacatacatctgagaaaaggtcaactattgacaatatttgtaagtggcgaaaccctacaaaacatgggacatgatatatgagcccctcagaaaagaaacatcggacaaacagactcgtgagctcgtttctccactatttcagtaaaatttaattttgttgcttgaaacactttcaaagttgatactgactgctcaagttgctcctcacacatgcccaaagttgagttaccctacctgcgaaccacctcccaactcatacaatttaatgatttataggcaggaaaaaaaaggctgacacagactcaacatcacaccaagatctcattgctcccgtcttgaaagccatgttcggaagcagcaacacgacatttggcggcggctcgtcgttcggtaacaacaacaactcgtctggcggcggtcttttcggcaacaccaacaatgcatcttctggaggcggaatgtttggggctaagccagccaccagcacttttggtggcggtggatttggagcctcgaacaccaacacctccaccaatgcgtttggggcagcttcttcatcccccttcggctcgtcttcgaccccttctcctggtcaatgccccggtaccactcttactccctttcagccgtttaccgacaaggatactgccaacggaaagatgatgaccaacatctacgagaccatcaccatgatgcctcagtatcgcacttggtctcaggaggagctgcggctggctgattaccaacagggtaagcagtacggcactgctggcgccacggccaccaacacctttggggctgccaacaccgcttctccctttggatcttcttccaacaccaacaactcgccgtttggaaactcttccacttcgggtggcaatacttttggtggcgggttcggccagaacaaacccgctactgggggcctgtttggaagctccaacaccaacactggtggtggatttggtacctcgtccacttctggaggctttggctccaacaccaccagcaacactggtggattcggcggattcggtcagaacaacaacgccactagcaacaccggtgcatttggggctgccaagccctcgccctttggtggtacctcgtctttcggcagtggcaacactggtggaggcatgttcggaagcaccaacaacacctccaacaccaccagtggcttcggaggtggattcggacagaacaacgctaacaccaacaccactggcggtttcggcggaggatttggccagaacaacaccaccaacaactctggcggaggtctgttcggtaacaataacaccaccaacaacacctcggggggatttggccagacttccacctctactggcttcggtttcggtcagaataagcctgctaccaccagtttcggccagaccaacaacactgggggtggtctctttggcaacaccaacaccaacaccaacaccaacaccggcggcggaatgtttggccaggctaacaacaatacctcaggtggagggctgtttggtcagaacaataacaccaacaacagcgggggaggtctgttcggtcagacaaacaacaccaacactacgaataacgcatttggtgcgaacaacaacacttctggaggaggcctgtttggacagaagcccgcaactaccggtttcggagcaaccaacacaggcactacaaccggcggaggactgtttggcaacactaacaacaacactaacaccaatacaggcggtggattgttcggcaataataacaacactaacacaaacactggtggaggtttcggagggtttggccagaacaacaacactgccaacactgggaccaccggtggcggtttgtttggccagaacaaacctgctactggagggctgtttggccagaacaccaccactcctgcctcgaccggtactactggaggaggcttctcgtttggccagaacaacaacaatgcctcttccaacactggagccaccggaggaggcctcttcggccagaacaagcctgcaaccggcggtcttttcggaaacaacagctcaaccaccactaccaacaccactggcggagggctgtttggaaacaacaacgccgcctccaacacctctgctaccaccggtggaggtctgtttggtgccaagcctgcgactactggaggaggtctgtttggcagcaacaacaccaccaacacctccaacaccggaggaggtctgtttggcaacaacaacgctaacaccagcaacactggcggtggattgttcggtaacaataacgccaacaataacgctaacacctctactggtggcggtctgttcggcaacaacaatgccatgaataacaataacatgaacaacatgggtgccagaaacaaccagactccttcgctcacggcgtccattgaccagaacccctactcgaacaaccccttgttctctggtcagactcctcctgctctgacctcttctggttccaacggcactgccaaggatcctctgaccacctctctaacctccaagagcggagccaagagcggcaacaacggcgtatcttctgcatcttacctttcgtcgtctcgaccactgttccagcctcgaaagaagacgtctgccattgcttccgagcatgttgcgcaccagcgaaactacccggaggaccggtttgagcgaatctctctacccgaggtcgcctctgctggcaacacttctgtgtctagcgtgggcaacacatctatgtccacggccagcaagcctcgccactctctgttctctcccaagacagatgagttcttgctggggtcggacgcctttgtgcctcgacgagagatccgaaagctggtcattgaccgttctggcgacgaggctgagctgcgacgtctgactcagggcgaggaccctgagctggaggatcctcaccagcaccaaaacgtccatgatactccttccaaggctcctctcaaatcatctctcagtactccgaacagccagcagcgaaagaagtcagtgtctttctctgcggctggagacaactccgtgttaaatggtttgaacgaccctgactcgcttgaaatggctcccgtttctcagtcaggaactccttcattcttccccaagtctacggcctctcctattcacaaggctgtgtctgtggagtcctccgccactgcttctcccactgccacccaaacttcggacgaggagattgtcgatgatcagggctactggttctctccccgactcatggctctcaagaccatgaccaccgaacagctcaaggccgtgcccaactttgtggtgggccgaaagggcttcggtaagatccaattcctcgagcccgtggatctgactgcggttgatctggacgagatccctaacaacgtcatcaccttcaccaagcaaacttgtatcgtgtacaacgacgaccaggagcggcctcctatgggcgagggtctcatggtaccttgcaagataactctttacaactgccgacccatcgccaaggacacaaagaaacccatcaccgaccccaagcatccctatgcaagacgatggattgctcgtctcgagcagcagaagaacacccgattcatctcctacgatctggagactggtacctacgtgtttgagactgaccacccttaaaaggtgtacttcaagatagcgaagaagtagatcaatgtaaactatgtatgtatgttaaaacgcattaatgtcgttactgtagaagtaaagtatcgtacactgtgctacagtagatgtactggtgcttgtagttgtacaagctgcaggtgagtagttacaatatatagaatttatactggtacaattagttggatgcgtctggcaagattcaattgaggcttatgcgttgatacctgagtcgttgtatacaatacctgggcgtaaaattgcaacaggtacaagtacgagtacagtgtcataatagccgtacagtacttatacattgatgtgcgcttctcctcatgcataacaatggacatgaagaaggtgctgctttttcgtgtgcctggctatcgtgcctggctatcattttcatgcctaaaaaatcgtgcatcattaattctgtcacgtctggtgcagccgaagagtgatctgcagcgcgcctgacgtaatactgatgattgcggatgttctgactttgaataatgcatctcaaaccgaatcagccgtgccccagcgtaccgaatccagtaatataaacgctcatattacgacaccgtttgtccaaacaaccctttttccgctttccgggaaaaaaatgtttaggttcaggtgcccctgaaatgtactgccaaatgaacccgctcgcgtgcctgttacacgtgtcattatgttgatgatggagatgagaacccagtattgtttatggtagaaaaaatggaccaataaaagatctttatcacggcacaattgagccacttgtagacgtgctccaaaaacgtttcctaatgtctaaaagttggagtttccgctttggaagcctaaaacccaaacgagcttcacacgttgcgtgccggagattagcgagattgttagaacgtgctaagtgtagttattggggtggtttttgacaagccaagcaagggtggtattttgacagctatcgaagaccatactcatcttgtagttgcaaaaacaaacattctcgtcgcttctctgacttgtctccaatgtcaccctcttcgtataagtctgcacatgtccaagacgtccgccccattccctaaccctagctgcacacgtacgcgtgaacagtgcattccttttgcaacccgtcaagagtggtgaacacacacattaggcacacaaacgacatggccaaaaagaagttgagagccggagaggtacgtcgcccggccggaggagccaccacagcaggagccgcagcttcgaacggatcagccaacggagctaccgcgtccggtaccacctcacgatctgtgtccggagagagtagcggagccgctggagccactcctcatgctcctccgagagcccgcaaccgcccacgagccgggcagatcaacacctctgttaaaatgacctctagcacatccaattcgcccaccacaagcgttccgtcttctccgaagacccccagatcacctagaacgtccgttccttcttctccacaggtggcccagtctcccaaagtgccccagtctcctcgaatcgtttcttcttctcgaccgggatccgctggttcgccagtctctgtcaaaaccagttcaaaagctgtaaaaacagaggcaactaaacagccagctactcgaaaagtggaggccgtggttatcgattcgtctgactccgaagacgagtttcacgacacagaggctgtggtaatcgattccgacgacaatgacgactacgacgctgtcatcgagaccgtcagccagcccgtgctgtctaaggccaaggtggtgcgaaagaaggagcccgaggtggccactacgacccagacagcccagaaggccgtatccggaattccccagatcaaaatctactctcctcacaacactcagtcggaattcaagcccagtgaagacgaggacgacgaggacgaagagatctctatgggggacaacaaaatcgagtttggtaaggagctcaccaaggatatcagcaacaagacggacgctgctgctgcttcagttggcgcgccaatcccctcgccagtggctttcactcctcctcctcctgtgaacttcactccccctcccgcaagccctcctgtggtggttgatctggacgacgacgacggagaagtgagatacaaggatcggttcaaaaagagagccgccgatacaaagcccgcagctggttctacaccaaagcccgaggaggaggtcattgatcttgatgaagagtcttcccaatcccccacaatcactccaggtgcattccctacccctggggccttcccctcatctgcaccaaagacaaagaaagagcctgtcaaagaggtcaagaaacctgtccaggagaaaaagattgaggcaaacgagcctgccagggacgaagccgagtcaaagaagaccaagtcaaagaaggacaccttgccagagacttctgcaatcacagaaagcgttgccgcaggtgtggccgcttctgtgagtgctacagctgctgcttccgaaatggcttccgatcatactcctctgcaagaaactccttctacacctaccaaggctggtgacgctaattcaactgctgccatcgacattgcatctggctctcctgtgacgtcacccaatggttcgcctctcaagggtattctcaaacagcccaagcatgccaagaagccgtccattcgagccactcacactaccatcacggaaccaattcccgatgactcgcttctcttctccgtctgcattgtgggatttcaccattctctgggaccccagatcgaggaatggtttggccccgaggactactctcatctgtggccaaacctacctttccaggctctcagtgatggatcccattctcgggaagaggacttttcatacttcactcttctgtttgatgagaacaacaagagcgctcctggagctggtgggtactccgatggacgtcctttcaatacccagaccgttacaacgctgtttggtatcgcctgtaaccgtcaggttggcgtgaccgatgctctgaagcaggatttggctgtgactcgaagtactgttcagaagtgtgttgtggttatatgccgaaagcccatctggggccccatgaaggacaagctggctgtggtgacacgtgcattctttatgcagcccacttttgacgataagtccatcattcgaagcttgtttgactcgctggcacacacattaacgctgtccaagttcaactcagacacttcttctgacgtgtccatcggcatgtcgctctgtgagctggtttcacgtctcaagcagaagctggtggtggtatttaaggccctgttgctcgagaaacgagtgcttttctacgcttcttcaactgagctgctctgtacttcacagttctctctggtttcccttattcctaatctcatcaacaacctgcaagattgcggatctcccttgctgcattcatacgagctcggactcactcgtgcaacctcacttaaaacctctgatcggcagtctctgctcaactttatgggactgcctctgatggtctttggagagggtggtatgttctctccctacattcctctgcagcagcttggcgacctcgctctggctagatactacctggttggaagcacaaactcactcctgttgcaacagaagaaacagcatgccgatgtgcttgtaaatatggacgacaacaccgtcgagattctcaactcgtcgttgaagtcgccgctatccttgtcgtcgtacgataagaagtggatcgaacgagtcgtgcaggctgtcgacacttcgtctggaaactctgcagccaccacattccatggcaatgaggactatgtcagactccagtttgaagactacctcatgggtcttctttctgccgtcaagtacgacaatttcctttcttcccatggctcggctcctccaccagagatgcttcttaaggaagtccatggcaaccctgtcaagcacttttctctggactgggtcaactgctggcgaaagaccctcaattacgagttgttcaataacttcaccgatggggagctctttgacattgtcgagcctagacacatggccgacgctggcgtcactgagaagcagaagtcgcctttcagtgaggttggcaaagcctgggctggcttgttcagtaagaacggttccaacactgctattgacaagacaagtggcagcagttccggtgacaaggagaagtctgtctctcctacaacttcctcagtgtctccttcggtggctactactgtcgctgctggccacggcacttctgccaacgagactgcatctctgccttcagacacttctgtgaagacacatcgatcatctgactccacttggtccatgcaacagaagtccacatcatggttcagccgattctcagctgcccccaaggacgacactgagtctagcgagcctctcacaccccctcctcctgtttctgaacgacccaaggcacattccgagacctctgtcagtggttggggcaagtgggccgccagcaagaagatgaccttgtttggcgatgcgaatggcgatgccgagaaggagaagccgcaagacaagacagaagacaaggcagaagacaagaaggagaatgagaaagatggggacacaaaagagacttcagaggacaaatctgacggtgctgagacggtcaaggctgctgagcctgaggaaatagagatgcattttgaggattctcccatcaagaaaaaggagaacatttctgcagcgacgtctcccacaaaatcagtcaaggaacgggctgcgatgttccaatagatataagatattaaagaccagttgtttttgtacattgtagctgtgcggataggtgaacttgatgacgtcgttacttctcaaataaaaattacttcggtacatgtcagataaggttatgcaggctactcaacctacatgcgtcaatcaccagtaatccacgttcatgacactcccatcaggccaaaaccaacaactcccacagcgaatgtggaaagagatctgacaaggatacaagtctacgaaggaatatttggagactgatcttggattgttactcaagtgtaggaattaccccaggactggagtagccggccggcttcacgattttgataccacgataaggacccagattcctaataggaaatgagcccacgcgacttaccatattcttaaaaacaatcctattacgacatacagtatatagttcatggcggccagaattactggttgtgattcatatctctccgccttggtacagtgacgcctgtcgggggagtctacatcgaaggtgtgtgaagatcgattcattcagggtaaagttatgaattaattatgagttacgacgagatatctgggtatcaatagggacaatttaccagccgttgcagaccttcttggtctggcaggactggcaagagttgactgcgccgtcaatcttggggagcaggtcctgcgtgagcttgccatggccaaagtcgataccacctgagacaattccaccaaggcaaccgttgaggtcgacaatgagacccttgcaggtgtgcaggagggtggcaatctgcgtgatctgctcgtcggaacaagacttggagatgagcttgccaataactccaatcagggaagaaacgacctggatggtcaagttcacgatggtggacaggccaggagcacagagctgcgcaagggcacctccctgctggaagatgatggagccctggatcccggcaatgagggcaggcacagattgagagaggccctccacagccttggaacagatagcaagggcagtggtggtggaagaaatgtcaccgtgaagtgtcaaagaggcgacaagggagacagcaccggaaatgccgacactgcaatcctgaatggtcttgatgattgggccgacgggagcaacactgccctggccaccccaagagttggtttcctccttggatccaccccaagatccacccttggagacttcgccctttccaccccaagatccacccttggagacttcgccctttccaccccaagatccacccttggagacttcgccctttccaccccaagatccacccttggagacttcgccctttccaccccaagatccacccttggagacttcgccctttccaccccaagatccgtggtcggagcctcctcgctcctcgagagcgggggcggccatggcggaggcggcgaggatagaagcagcgagagagtacttgatagcaaccattgtttgatgtagagaagaagtgagtgttgtttgatatttattataagagggggtgggggtggtttatatattggtgacaagtgggtctgggccgcttcggaaactcggaatccagggtccaggaatgagagactcggtcttattctgcatattgacttgactgcagattctatcaacacgcaggtattattactttgttctgagggtgggcacggctatatactgatggaaagtagtgctattggaagcggttgacataaatctgtggttagagactgacccccttctgcattctatcgactaaagatgatctccagcatctccgagtaaggctctctcagttctagtgaactcttcattctgctggagttaaccgccaaaaccctgaagcatcgccctcgacaactatatttgaaacacagtggtgatatcgcattcttcttcttcgtatcataagttaatgtggttgtttgtttgacacaggttgaagaaaggacaggggagcagatattatctagcaacagtacaggcacctcaagaaaaattgagactatattccccactcagtcccattaaccacaatgatattcaccacagtcagtcaggcagtgactataatcgtttcccttttgtgtaatggtaataagcccatatttccccagaagaagtgcatggtagaaacactctaccttgtctccatctctggtcgagaggacactgtaacgggaggtaacgtgcaatgaataaagaataacagcaaggggggagaacactgccaggggcgtaattatccactccaggtgaacaaattactactttggtcgacgttctagcctgacttctttctcttgtgtttcatgattagcttttatggtgcatcataccagatctagaaaatgatcggcggggatcaacaacggcagtggttaggggtatcggtatgaagatatgttgttgaaacttgtctgcgcggctatcgagagacgactctgtgtcagattcccgtagcatgttctcacaattcttatcttttcactggctttgacgatctcatcccgattcaacccttccccacaagcacaacgtctgcccttgcatgtgcaccatttataccctgagtctatggatacaacgaaacaagcccatatctcttcctatactattctaccataccaatagtgaatgatgcaagttaaggaacgtgcataattaccacagacgagagctactcatagtaccggtacctgtggctatttttggcagagcagtcgatttccaaatatgcatgacgatagaggttatttcaggggctaatttcaaaacgggtttatcagaacaaagacatgtacattatttattagtagaactgtaaatacccccaatgcatgcttacttaccactcattttaagactgttttccctcgtttagggcaaatgcccatgcaagatacacttcggctgcacgatgcgaaacgtttcaggtggctgaagcggagacatgtctgtcttgtattgtacgagtccttgggcgtggcgagtggtgatggagagtacacatgtgccaataagataaccagaggcggtgtttatatcgaaaagaaggactatagcttattgaaacaattgacatcgatatcgttccaagctgagtattggccaaaaggtggctgtcgcgttggaaggtctatcagatcataaatgtcatcctccctacaacagaactaacaaaaacaagacagaaatcagtatttacatctctgttaagcgtatacactagacgaacctattgctcgtgtcatgatgtctcaaaaaaaaaaaaaagtgaggaacgaaaccacagacaggttattgaaaacaatcgactacttgtagctatatatagaaccacaatgcgtttcatgcgttaatattcgcgccgccaccgtttcaaggtatctacaaggtgaacgtgattctgttttgacagctttatctgctaaagaagcaacctcgaagtgtatcaagcgcgacattcacttcagaacgagactggtgtttcgagtgaagtgtcattgctatactctacttacattttacattaattaagtaattaattactagtagctactgtaggttgcctttttagtattgatatccagtccccaattgtatgtattccgctcttactatacacacaagttgttccactaattgtatcgaaagagcttgaagagtttatcacaactacttgtacatactgtatgaagagtatttgtttctatcatcgggtttatctacttctagctacttttggtcatagcggtctagaatctggctaaggatgagatgaacgaatattcaagccagaaaagtcattcaacgctttttagtataaatgtaaggaaagtggctagggttaatcgtagagttacagatgctgtaaatcccccatttcccgttcttttgtcctttcaacagttcaaattgtgatagggacaagtctgcacctcttcccagtaccacacagtctccaactaaacttccaacaaatcttctatgtaacaatcaactaatattgcgcatacaagatgcataaaaagtctattttagaactacaacgaaatattgtggatcacaacatcgtcaatcatcatctctcaaccatgtctcaaccgatagaaaacaagatagctggtatgaatgcggcacttggaagcatgtcttctatgttcgcagactacgtcaacactgtcaaaacagactacgagcaccagatcgcacaactggagaaacaggtgactgcccttaagatgggtgagcaagtggattccatatctgtcacagaccctcgggagaacctgccgacattcccactccccattcaacgacagaagtttcttgaacttgttgatcgggacaagaccaaccagatctacgtgtattcgggtgaagtgaccgaatcgcctgcattgtgggccagcagaatagagaacatcatgaagacgttcaacttctcgacatgcattttggaaactagtcaggtggtctcaaaactacttggaggaaaagcgctgcttctctacaggaaacagaagaaccaggtgcttccatgggtggagttgaaacggctggttcacacgcttgataagcccgtattgagaagtatcgcagtgcacaaggaactggcaaagctggaagatacagatctaccgatagagtacaggataaagatgatccggcactgggaaccccagctggaccccagtcctctgggtgaccgggtagtggaggtaattaggatcattcctgagaaggaggcggatatcatgaaggcagtggagggaggcatcagcagctttgatcaactcttgggaattatgggaccaaaagatgagagtagccatcagcctcagaaggcggaggaacaaccgccagtgctatcgtacaagcagaagcgggcagcaaaggatgtcagagacaagacttgtacgtattgtcataaggagggtcacaaatccagtcaatgcttcaagcgtcccaaaagatgatcttgatagtacgccaccattaaattattatagcatagattaaacatgaattttcattttaatattgtattactgtagacacatcaagcaagagcctctggaagtcatctgaaatgtacacttccaaatacctcttgacctctgcgtatcatcaagctctgttcgaaagtcgcgattgaaacttggctatagacttacaaggatgcggtggctgacaattacttcactgacggtggccctgatttcgtatgtggcctcttaactgtgtaatagacttcatggccgcaaccattaccatgccgtagtagcttggtaaagactgtgtcagattacgcacctgcacatctcttggttgtgttgtcagatttccccagcgacagctcgatctttgggttgggaggatcactgtcttcgcccacaaggtgagaaaaaaagtgcctacatcaggtggtttgtttgagatcaacaaaaagtacagggtatcaccgtgccggagcgcgttcaagggctctgggtcaccatcacgaggtatctcaatgtgaggtatcgtcctaggtggaaaaatcaacttggtcgtgtatctatttgttgggtgtcacgtctcgttatgactatcgagtagtatggagtaaattacctacaattagccctacaaatctaaatagctacaaacacatcccaccctgtcacgctctcccgatgtgagagccgctgctcatgcatatatccttacatcttaaaattagagacacagagtcgagttccctcctacaagtaaacagtaacgtgtcgtatcgtacgaccgtagatgtgcctaacaatttcccttcgacaccaccgaacagcagtgtgttgcaaggcctctcacacagatgtgttacctggttgagactggcaccgcgccctacaagtagagacacttgtacacttcatgacaagcttgtttgatcccgcgtactgtgtgtccttactacacaagcatttacaagaaccattatgtttttcagtatttgccatgagtaacttctcctttaatttttagaattaggattgctataacaagtcagggacttggtttttctagtttttttctcacaagggtaataccttccttggtcttagagaaagtactacttgtagctacttgtagcgacaagagagaaacatcggtacgacacttcaccctacagtatgtactgtacagcacatagtgtacctacaggagctactccccctttccccccccccatggccactaaagttaccccaacttccccacaaagcctgcttgcgatttggtttcatttaagacacgggcacggtttgtgatgttttgcggataccgagaaagtattcagtttagcgcctcaagtatagtcgggtatcgagggtgtctagttcctgggaacctcataaatgcactaaaagtggctctttttgtatccattgccacgctcacatcattcatagaatgtacattttccggacatgctcatcggagttacagacattacgcgactttacgacgggctaactactctgaggtttatttccaaaggtggggtatgtatttgtatgaaaaacttgctttttgctgcttccgtgtatgtacgagtcagacagtgccgacgtgggggggttcgctagacttttatttgactatagattttgataatactctgtactgtaccaggagttctgttgatgcacctaaccacgaatgaacctgacttttctgcctaaaagtattgtatttggtacagtaagtagttgtactgtaggtggcttccgtgggcccttacagtaacttgtctacatcatacccaggggatggccttataaagctagaatcactctaccttcgaagggggccaaatctgctcacagaataaacaaccactttacccaaaaggcggctgtggtgaacacactttatccagccgggtggggctttaccattcgttattgcagccgtgtttggtagaacattgtccaccaactggagcaggcaattgaaagaatggtcgctaattgtatttcataagtcacgtcacattattatccacctttttctgcaataacacatttgatctaacacaaatacccccacagtctcatcaaatcaagacatctatcgtcttttgtcatctgtctatgcttttttgaccagaaaaggctgaaccctatgcggtcaaggttggctaggttcagaaaaactctgctcgtgagtcatcatgtgtttgaataactgttctggcggtttggggttgttatacgacgggtatttctcatccactcaagtctaccaacgaagtacaacgttgccaagcattatggtgcccagatcatctcctcctccttcttggcacataagcaatgcactacaccagcttcttgaactctgtcttgaaatgcggggaatcattgaattgatctgagacacagttccgaggcctatataacctattggatgtcctagaagtgtttttggcacccataagccagtatggataaagaatcactaagtcacgacgaatacaccgagtcaggggggcttgagcatgtcgagtaccctcagggtcaagtcccgcaagaagttatcgacgctgaaattgcgcaacttgctgaaaagtacggtataaatcaaaggaaactcatgttcaaggtcgacatttgtgtcattcctgtcatctgtatcctctacattcttgccttcctggatcgagtcaacatttccaacgccaatgtttacggaatgagtaaagatctcaatctctacggtgaccgtttcaataccgctcttgcaatcttctttgttccttatgttgtcgctgaaattccttcgaactggctcatgaagaagttcacgccgcacgtgtggttgacaggcagcatgctactgtttggagtaactcttctgggtcagggcttcgccaacaactactctgcactcctggccacacggtttttactaggactctttgaaacaggaatgtttcccgggtctttctacctgatctccatgtggtaccgacgagaagaggcccaaaagcgatactctttcttcttttcaagcacaaccctggccggagcctttggaggtctcattgccgcaggtattcataatctcgatggagacaaaggcctcgcttcgtggcggtggatcttcatcattgaaggtgcctgtactgctttcatctctatcatcatgttcttcttaatggccgacttcccagaggacgctaaattcttaactgagaatgagcggcagttcatgaaagagaagcttgaagtaggaaatgcaggtgccagtgaagccgagagacccatgacttggaaagacgttaagagtgtcttttctgactggaaggtgtgggtcatggggtggatgtacttcggcaccattgtacctgcatacggatacgcttacttcgggacagctattgttaagacgttaggatattctgatgtcaagacccagctgtactcggtccctccctgggtggcggcctttggtttctcaatgttggcagccatcttctcagactacctcagacatagattctattttgcagtgttcgccggtatcgttgctatagctggtctggcagttgttattggcgtacacgacaaaattggaactcgatatggctctctgttcatgatctgtgccggaacctacactgctatgcctctgtttgtgtgttggacccaaatgaacttcttaggccatcataggcgagctatcgcgtcaggatggcagattgggttcggaaactgcgctgggttcatttcgacctttgttttccaagcaaacgacgctccattttatacgcctggttgcgccgtttgtcttgccttcgcttgtctctcgcttgttatgcagtttgtctatgccgctggaatcacctgggaaaacaaacgaaagcgaacaccagaatacattgaaaagttcaacgctctctccgaagatgataggagaatcgcaggagagctaaatcccagcttcttctactactattaatttatatgattatcttaataaatactgcatatttttatatacatactatgtacagctactgttgcagcttcttcattcgagcagcaggatgtctgctcaactcctggttgttaggacttgcctcagatcgactgatcatctgcttcagctcaaataggacgtcatcatcctcctgaccaaggaaggtaacggcagtacctcgcttaccggctcgtccagtacgtccgattctgtgtgtgtaggactcaatgttgttcgccatctggaagttgacgaccagcgaaacattaggaatatcaagacctcgaccagcaacatcagtggcaacaagcacatccacagcacctcgcttaagatgctgaacagcctgttctctctgctcctgttgttttccaccgtgaataatagctgttctccatcctgctgcaaccaaagcatctgaaacggcctcacagtctctcttgtagttgaggaaaacgacaattgggggtcggtattgtcgcttactaatgatatcaagaagacgacgctttcgtttctcgtcagtgttaagaaattcaaccagctgtgtgactgtagaacccgcctggccagcagaaccaatagtgacaataccgggacgtcgaagatacttcttagccagcttctcaatagccacgggcatggtggcagtgtacatcatggtctgtctgtatcgcctggtggatacagccgcaaggttttcggcctcatcagagtcgggcttagcatttgacgagggtagagacgccagaaccttctggacttgctcctcgaagcccatgtccaccatacggtcggcctcatccatgaccacatagcaacactggtttagaaccaacagtcgcctgtcaatgacatcaagcaaacggccaggggtagcaacaattagttctgctccttcttgtacagccagagcctgctcttgagcagagtatccaccaacgacagaaaccaccttgaagccgagtggtgcgcagaacttgactgcttcgtctttgatctgcatagccagttctcgagtgggggccaaaataagaccgtagggaccattaaccttcgatctctcatctagcttgggtaattcacaaatgtagctgatcagagggatcagaaaagaggcagttttaccactacctgtctcagcaacgccaatcacatcccgaatgcctagagcaataggaatagcagctctctggataggcgtgggctccttgtatcccattcgagagattgtatcacgtacaattcctggtatttccttgcactcattccacgacctaagaggattgggaatatttcctccgcccttggtgacaatgctgtaatcttccttgaagatacgccagtcacgcgacgtcatgctttccacaggtttatcagaccagtgtgcgtcctccaggtcacgcttttggcgtttgggcacctgcccatctccggaatcgatactgtagctgggctgatatgccttggaggtgtcatctgcagcactccagtcgaatgaaaactttccagaggttgattttggcttgggtttcgaagggagaggcttggtggtctccacagtctcctgaacaactgaccttttcaggtcggtggtagatcgaatatccttcaacgtagtctcttcagatgtcgtgtttttctggatctgtttggccttcgcagccatctcggcccgcttagccttggagatgaactttggcttagaagcctctttcttttgaacctgcaaagccttgagctcttctatcgacactggcatagtagttcttgttggtacttgtagtgaggtgaccacttgtatattataaattggagttcattcaattaagttcatggtccatatgcagctggagatcaaggttgttaaggtgggttgttacttggagtggaggtgcggagagagggtgtgcgacagtggcgaatatctgtatctataatcccacatcacgaccagtacttcttatgaaatcatttagcttcatcaaccaacttgaggttcatacatgtatactcctatcgcatgcacacattatgctattgtacgccataagtacaggttatgagctacacctttctgtataatctccatctaacgacatcaatccgtcgctcaattacctcaaatgttgaaccgaaccccatctacagtacgtcttctcccaataacacgctgctcgttcggaatcacctatacgtgaccacttacaaaagcaccaccaattaaggttgtcgccacacatcaccacactcaatcacataggattcatcaccacacaatcatactcatttcagcacagacaaccatgaccacagaccaccctgttttggctgaaatcaagcaatccttcgcctttctggagaaggccgtcgcctccttcgaccagcgattcgtcctgcgagtcctacgaggtctgcctgctctacgaaaaaagctcactccagaattgctggcacaaatcgccgtcatgacctaccctgctggcgatgagcgaagaagcgggtttgttgctctggctggagtcaaccccaacaccgacgaaatggaggttgatggagcctctggcgccactgaggccaccacccagcctctaccagagatcgacatgtacgtttcactgctgttccaggcctggctgctccacgagaaccgaattgacgacttgcggaaactcagcgagcacgtggtggctagattgagaacctataaccgacgatcgctcgactaccttgcctccaagatctggttctacctgtgtcgaggtgaggagctcagtggcaacctcgaggctgtccgacccatcctgctggcatctctgcgaactgcctctctccgacatgaccccgagactgaggcctcgctgatcaccctgctgctgcgaaactacctgctctgtgcacatgtgacccaggcctctaacctcgtgtccaaggtcaacttccccgaaaacgccgccaacgctctggccgctcgttacatgtactatctgtccaaaatcagagcaatcgagcttgactacacagctgcccacgcccacatcactggagccatccgaaaggcgcctcagacccctctggctgccggcttcctgcaagccgcacaaaaactcaacattgtgatcgaactgctgatgggcgacattcccgaacgaagcgtgttcaagagcggacgggagcagagcctcaaggcttacttcgaggtggtcaaggctgtgcgagtcggtgatctcaaccagtttgctgacacaatcaaaaagtatgcatccgtgttcaaggccgatggtacctactccctggttctgcgtctgcgacagaatgtcatcaagaccggtatcagaatcatgtctctggcatattcacgaatctctcttaaggatatttgtatccgtctgagactcgagtcggaggagtctgcagagtacattgtggccaaggccattcgagatggtgtcattgaagccaccatcgactcggagcgaggattcatgcaatctaaggaggtgctggacgtgtactctactaacgagcctcagcagaccttccacgaccgaattgccttctgcatcggtctccacaacgacagtgtgaaggccatgcggtaccccatgaactccaaccgaattgatctgaagaatgctgacgaggctcgtgagcgagagcgggagctggtcaaggagattgaggagggcgagttggacgacgatgacgacgaggattttgatctttagataggctagcatatgattttagaatgtccaccattgtaggtaatgtgttacgaaattgtaattgggttaatggcagctgtagactacaacgtgggcgtttactttgtcccagactccgtttctgtgatgccctattatcctattttattgcaagtaaccatgtctccttctccttttaggcgagtatagtatgtgcagtagagatgacaataacataggttactactgtgtacaagtacgaggttatgagatcgacaaatagatgtttttgggttcatttacacgggataataagtaattcttattcgtatgacggaaaaccagatgatggtagctttcctcttcaaataccggtacagtacaatagtaattaggtacgggaactacttgcagtacgttgggccaattcctaaaaaactcaaaattattgctgcagctgcaaaccaccatctgaagatgtaaatatcaccgaaccttgactcacgacaatcaccgacacagggcaatcatcaagggcacattaacgacaccagcatataaaccaggagagacgaccatacagtactagcgacaccaaaaagcaatcatgagcgacatcaaagtcaccttagcggtggaagatcgggctgagaaccaagacacattaagtatttcagaaatcgtgcctcggatcgttgctgaacggaagtcgttcgtggacgttaccgaggagtcgctactcgaggaaatcgccaattgtgtggctgactcggctgacgacaatgtgaaggatgaggtggatgagaagcccgatgagtccccctttgaccagcaccgactcaagctgctggagaacgtcaaagccgcatacaacgagagtgcgctggcgctagatttcgtgtcactgctcatttcgagcgtgcgacccacttctgcatccacgtccatgtctccacatctcaaaacacacattcctgtgggctctctgggtgcagaccgagtgcctgctccccaggtggccaacgagcccggcgttggcattggatggaaaattgagtctttgacaaacgcgcgtgaccgactcaagacgtgtgcttcgaggctgcggactgaggctgccaaggagaagacctactgggctggcgttgcctctattgctgcgactggcgaggttcttttcaaggtgcgaaattctgatacccgagggctaggcatcaagtatggttttggagacgctggaagtaaatatcgtgatccaggtatcggtgtgttgaagcgttcggctacaggaactgtggacttcgagcccaaggaggaggtgcaaaagaagtttgtcagagtgactattaagtctgaagagggagaagtcaccaaaagtgtcagcaatgtatataccagggactctaagccgccaactgacccgacgctagctgctattcacgagactcgccatgcactgtttgaagaagagttgttctttgagattgccagagaggcaagactgctgacctcgagaaaggtgaccgttgctgatggagctgtaacggtggatctgggcgaaggggacatggttgtgattgagtgggtggaggtcccagaagagcctacaactacatttgcaccttctctagcaaacttatttgtgctggcgctgagactgctgctggctaatgctcatcgacagcaattggagaagatgagaactccccctgctccgttgcaatctaagggtggtcccaatcccaaccctcctctgcctatactaagacctcttctcgcacacattctgcacaagcggctggtgagtcgcgccagaagatccctctatcttctgtctacaacccattccggtctcagcttcgagataaccacaaacaactctacagataaggaatcttcttctttgggtcgactcatggcagctcctgtttccaatctcaagatcaagttttcggacaagggtaatgccaaggtagttattccttctcctctacagtcgcatcagtcgatgttcgatgtgaccatgttcaagggtacctctcaggagactgtgactagccatactgggttccatgagctggtcgagttggaagagtgggtgcggtgggctgccgatagatctgagcccaaaaagagtaactaagtggccgactccactcaagtttagttgacacgagttggctcacttttaactattacttatgctgtcgttttcagctgatccattaattatatatgctgtactaatgggagtcagccgacagttaggaattgtaacaatacacactttgtataaagccactgtattattcccacgcacacttgtattcgtacttatcctgtcatacagtagttatttcatgatcctcttgtcaactcgcgctcggatctacagtagataagctctaccccatctctggatttacacgtgatggtgaactctgtcaggagggaataagataataatccggcaaacggtcggcacagaaccaaaacttgaggggcaggtaacggactgtctgacagacaatgaataataggaaaagactgagtgtcgcccgtctggttagtaatcgtcgtcccttccattgggtctgcgagtactccattaaattaaataccactccctgacaatcttccagcatgttctgtatggcgctcggccttaacaaggctcccccacattttaagtatcctcggccgccagcgcggtagttgcaaccttatcccccaactgctctggcttcgttagtaagaaacttttggaacaggccaacgtgaaaaattgagtgtattcgaagtcgtcagattgtggggtaataggggcgtgaaagacaaaactttaaggatctcaatatgatgagattggcgcagagtaccactctgtgcagtcgccactgaatccacgttgcgcacgtggccttatgcctcggctcaaattccccagataccccattcaacaagggtaagggcactcagtcgtgggggaaccttaatgttactgcagtgactgccagcagagaactatagacttgcatattacacatgatttcctttggactgaaataactaaactgtgactcttgccaaccacttttcttgcacacagcacacacagagaccaccaaagcaagcaggaaacatcattatgtcgtttatgagaggaggaagcgaatgctctacgggcagaaaccccctgagccagttcaccaaacacaccgctgaggaccgatccctccagcatgatcgggtggcgggtccctctgggggccgagttggaggcatgcgatccaacactggcgagatgtcacagcaggaccgagagatgatggcgcgattcggtgctgccggacccgagcagtcgtctttcaactacgagcagatgcgacatgagctccacaacatgggtgcccaaggaggccagattccccaggttcccagccagcagggcgctgctaacggaggacagtgggcccgagactttggaggacaacagaccgctcccggcgctgctccccaggacgccaagaactggaacgccgagttccagcgaggaggatctcctgcagaggccatgcaacagcagggtcccggccccatgcaaggcggcatgggtatggggggaatgcccatgtacggcatggctcgtcccatgtactctggaatgagtgccaacatggctcctcagttccagccccagcaggctaacgcacgagttgtcgagctggacgagcagaactgggaggagcagttcaagcagatggactctgccgttggcaagggtaaggaggtcgaggagcagactgccgagactgctactgccaccgagactgtcaccgagactgaaaccactactgaggacaagcccatggatatcaagaacatggactttgaaaacatctggaagaacctccaggtcaacgttctcgacaacatggacgagtggctggaggagaccaactcgcccgcgtgggagcgagacttccatgagtatacccacaaccggcctgagtttgccgactaccagttcgaggagaacaaccagttcatggagcaccctgatcccttcaagattggagtcgagctcatggagactggcggtcgactttcggaggctgctctggccttcgaggcagctgttcagaagaacactgagcacgccgaggcttggggacgacttggagcctgccaggcccagaatgaaaaggaggaccctgctatccgagctctggaacgatgcatcaagctggagcctggtaacctttctgctctgatgaacttgtctgtttcttacaccaacgaaggatacgagaatgccgcatatgctactctggagcgatggcttgccaccaagtaccccgaggttgtggaccaggcccgaaaccaggagcctcgactcggcaacgaggataagttccagctgcactctcgggtcactgagctgtttatccgagctgcccaactgtcccctgacggagctaacattgacgctgatgtccaagttggtctcggtgttctgttctacggaaacgaggaatacgataaggccattgactgtttcaacgccgccattgctgttcgacccgatgatgctcttctgtggaatagactcggagccacccttgccaactcccaccgatctgaggaggccattgatgcttactacaaagctctcgagctgcgtccctcttttgtgcgtgctcgatacaaccttggtgtgtcgtgcattaacattggctgctacaaggaggctgcccagtatcttctgggggctctgtccatgcacaaggttgagggagtccaggatgatgttttggccaaccagtccactaacctgtacgataccctgaagcgagttttcctgggtatggaccgacgagatctggtggccaaggttggaaacggaatggacgtcaaccagttccgaaatgagtttgaattttagtatatagtaattgattatttaaggatgagcgagatgatacatatacagtatttactcgtaactttctcactgcatgcaagaaccatgccttaaaattgcagtactgtacagtacaattgtactgtatgtacttgagctgatacaggcctgcttcaacactgtaatacgtttcatatataaatacctaattaccccttatgtgtatataaataatggcttgggatggtagcagccatggattattggccaatagtcccggtatggtttggaggcccaaggttattagtgagtcccagatcggttaatgagctctttatcagttagttggtatgttttgtctcagtgctgtctccactttgaccactcacgatgctgttggatctaggggccgttctctcactgttccctgaaatggtacttgtgccaaaaatcagttcgcgcgcaaacccatcggatagttgttcggcatccataatggcactaggtgcttggtcctcgaatccaagtaggtcgttcctagaccgtagagagcccgagctttcgcttctatcggcgtagttcatgggcctctggtcctctggttcaggcagtctatgacccctgccgccgaataacccccaggaccagcctgaccatccggaccatcccgtgctagcctgaacagccagacccgaaagccattgcctcacgtttgtgtcccctatggagtgttcaatgccgaattctcccgggttggcggccgcaacatactctccaaactcattggccggttcagccccctcctgagacagcagggcctgggcctcctcctcctcctcgtacatgtcgaactggatggtatcgttctgtcgctgacaacaccccaggcaggagctatatatttcctttagtgtcatagccgtgggtgttctttcgagtgacctcttgtaaagtcgcgttgtatattgttgtttctgccgtattgcagcgcaatagtcggaaagtgcaattctggccggtagttcggttctgggttctcaatatgtcgtattctcgcccttatgagtgtcagagctcgtcggcggtctggtccttgtctggaacggcgcgtagctcgttatcttagtcgcctctgagatgtgtgtggggtcactcacgattactcaactttagtctaaaacggcaacttaatgaattctactggcaacggagaatactcaagcctctcataattcgggctgacgagtaaattaagaggttctctaaaatgaacgccagccactggtgttgggtctatatgaaggcatactctagattccttcattgatattcacatagtgccatggactgactgtacatcagcagacaaacagcgtactaatgaatcccaagcttttgactggtcaggaggatataggagatgacgtgattccacattacacaatttccccagggatgtgagagataaccctgacaattgaaagaattatagtcacttttatggctgtcactaaactcgactcgatccaattacttgtacccatactatccccatcgagcgatttctgtctcattcatacctcaccccattttatttacagttccgaaccacaaattctgtcgtgctgagagattgccacaggtacatactgtactgtactggagctgtactggctgggaccatactcgtatgtactgtaaccatggttacggatgtacaggaatacatggatcacagtctacctgtacgaataatttcaattgaacaattataaagcaccattatacttgtgcgagtattacactatacagtattatgaagtttgctattttatttactgtaattctctagactactgtaactactgtatttctactgtacttgtacatacttgtgtacagtagttcctccccatcacttctcatgtaaaagatttacaccagagctcgccttaatatacagtacagatgaaacccattgttctacacctaaagaaacaaacacagatatatattccctcgcgatttacttcccgtgaggttaaatccagctccacaacaggcttcttagagcggcctacaccgcctaattccatcacacatgactgtcgtactactccaatctattactacattgatatcctactttcatcgccattcccgttcgtttagttccttacctggtatctactggaagttgaaggaaccctgctgctgctggccaccaaatgcaaatgcatcaccctcggtctgaggagcgaggtcagtgtcgtccacaccctcgtcaccactgaaataggtctcgatgatggtgtaagccttcttgtagatggcctcgttgtcgttctgctggcaagcatggatggcctccattccatcagcgtcctcgatgaacagagcgtactcgttctggccatcacctcgcatgtgtcgatcggactcacccactcggagaatgttttcaagagcgtcaagagaaatctgaatgatcttgttgtccatggaacccagcaggtcacacagaggcttaatacagccctgctggacaaggtatcggatctggtcgggcttggaaagaccaccggaggtggcgttggagatggcccagcatgcctcctttttggtcttgacctctccggtggacaggagctggataagtggggggataaggttgctgtcaatgacagactggatctgggtggagttaccagcggtaatgttggaaatggtccagcaggcctcctttcgaatagagtccttaggcgcagtcagaagctgcagaagagcgggcagggcaccggcgttaatgacaatctgggtctggacgtcatcaccagtgacaatgttaccaacggatcgcagagcaggggtctggacagatgtgctctggtggccgaggagctcaatgagtcgtcgggggattccggcgtccacaacggcctgaattttgttggtggtgccgtcggacaggtaggagatggcccagcaggcatcgataagaacctcatcgtcataggagaagatgagcttggcgagagcaggaagagcgtgcttgataacctcccagtcgggctgggggtacttgcctcggcagaagttggacagagtccatgtggcgtttctgatcatggagagcttcttggtgtttgtggcaatgttgatgagaggctggagagcgtcgcacttgagaacgtaatctcggcactgaggggagtcaccggcaatgttaccgagagcccacacggcctgctctcgcacattggtctcgggagagtccaggaggtgcacaaacagaggcacagctccggaatcaaccacaaccttggtttgttcgctggtaccggaagcgatgttggtcagagcccatgcggcctcgaattgcagcaggttatggggggacttgaggaactcgacaaagtacttgaccacgtcgcactggatcacctcgttaatgggtggcgatcgctccttggagagcagctttcggaacttggtggtggcatccagctgggcctcgaggttgttgctctgaatgttggcaatcatctcggggaaagcatcctgccactggaggttagaggaagcagactcggcctcgtcctctgagtcgtctccgcccaccagctcgctcatgtttcgtcgcttggacagctgttcctctcgtcgggcctttcggatttcgacctgggcctcatctcgtcgtcgtcgcagctcgtcggcgctgaatttgttcttgtccttgaaatccgtctttcggtgctcgggcacaaatttctcgctcatgttgtggtcgggtcacaaaggtgtggtggtggaggaggtaagtaaaagaagtactgcacaagttttggattctttttttccacacgcagactcgcacacaaacatggtctttgggacttacaaccgaaccttaaccttacccctgggggacgacatactcgaaatttggacgagagccgtggagctgtagaagtggacaattacgagcagctgatggcgaaaattctgatatatcagtatcccttggtcaagcaacaattttacctggtttttcccccacccgctcgtgttttgcgtccagaaaatacagcgtgatatgcaccaactggatgccctcaagacgcaaaatatgacgtgcgctacagtatgtaaatgtgtgaatagactgtgttggcgtgtgctataggctataaaaacgacgagtacaacttccctactgccagaaaggcatttctagtattctcaatggcatccctcacctccgaggtattatttttcgagatcccacgcttggtcagccccaattacaagcagtaactcgcgggggacagagtggggctgcagctttccaaatactacatccccatgattcagctctaaaaatacatcttgaattggaatgaaaatggcatacggagtgcgaaagtatcccgcatgtcgattattgatacaaaatgcttctgatacaggtgtgttcattttcagcctcatccagttcctattggggtatgtggtagcaagctggattacatttaggcaccgacagcaagcaaactagagataattccttgaatgggccacgataccataccgatgagggtaaaagaagcatggaagtggtggtaaaagataaatcaattgataagttcctctgtaactgttgaatctacctcgcaatccctttataatcataacatctgtcttatccctgtccatctggtagcggtacttctaacctgtatacacaccaactctaagctgcaagtcacacgctcccgtacatatccacacacactaagagatcaacaaaaaagtacacgtagctccttccagaaggtaatttgaacgaatttgaactacaaggggtgcgagagttgcatatttctgcaataatgccctcggtaaggttgcacgatattatccattcaacccaccccttcgcttctcccgtgggacgacacatcgcaacagagctgtgatctgtcgtcaacacagccgcgttgctacgcaaccattgtttgcctcacatctggcagttgccatgcctctgctgctgcacttctgtagctagaatcccgttgcaactcatacggtgggtaactgcagcaggccgggtaactgaacagatcagagttcgtaaattcccaaacagtgccagaaaagccaatggtcgttgtcccagtgaccataatgattgattagctggtataatggtgcaagtacatacagtagtgctgttggtacgagcactagtacagcacagtagagtagcagagatggcgatattgctacttagagggtctttatacgcagagtgtgtagagtaaatgacttatttccgagagagattttgttaagacaatactccgaagtgtacctccaagctgaaggagatgtttacagtagaaaaccagtctacagtgaaaaccattggcatcttttcatcttgctcgagtgtactaaagcattacttaattttgtaaatactgtcaattaattagtgacacttctacttgtacgtcatatctataagttaatgcatcaagtgaggtcgatgacctcaatctcacttgcgtttttagccccgagaaacacaacgtcatcgtcgttctcgtcgacctccttggatatctccacgttttcactggcgcaccatttggtatcggctattcgcttctccacagcagcgagaatctgctcacgcgtaggagccctcggccttcgtctaccaggaacaggtggtggagagggggtagagctacctaacacattgcctgttcctgtgaatcgcttttgtcgacccgtctttggctttactacctttgaaggagaaagtgtgacatttgtctttggtagagctcttccgccaggaccagcacccaaacctggaatgcctgcaataccactagctggaccgttcaatttacgtccacctccactaccaagtgtcttgccaggtcccaggaatccgtaaggggtatctgggttgaaacctcgtgcctttaatgcataatagtcgtcctcaagctccttgaggtacgcgtaaaactgggcattgtgaggaccatacttgttatggcacagttcatggagcagggtgcccatgatactctcaaacggtaggaacatcttgtcgtcgtaatgctgtctcaatctcaaacataccttctggccatggttcacgttgagacccaataggttggcgtgtttggggaacatctcacacagagtacctactttgaacccgtggtttttcatgatgggttgcacgaaccgtgcggccctggttatcatttccagagcagcctcggatcctggccgctttttcagtactgtgatgttggagatgaactccatgacatttgagtcgagtcgtctgctttgtcgtgtatatttcctgattgtgtatatagtatttcctgattccagatttagcgttgtttttccaatatggcgttttaattatcttctgcagcatgcacgatgagcttggatggcaaacacgcgcgtaaaatatctgtgtgaaggcggctattattggatctgaagacgacatataattaatagagagtcgagaagggcattggggtattttcctcaaagtaaatatagacatttctcagctatcacatataccaaccatctacttaatgaaatgctcacttgttcttttggaaggggttacagtacgactgtcatggggtaccccgcaacaaccaatatgtggcaatagtgcttgaccctccttccacatcatggatcttccttctgtttatgaatatttccccttgtcgaaaatgctcaagtcaacacccacactacaactacagtacacagagcaaacactcatttcgcaatttcaggtggcaaactcccaattcaaaatagaggttcttacacctgaccagatcgcagacatagaataggccctgtagtaccacgccgtatcccgttgggacgcactgcatttgaaaatatgaagaaactggtcaagagtgaaatattaccgatacaaaacgtctattccgttacagcccaaaactgcctctaaccgcatgtccttccagctgcacttgcctacaattagaatcaaactcaattccttatcacgagagaagctagtttaaaacattagttcacatatcaagacgccatccctctgtctcacactactcttccaacatgacgcctccggacgaccctattgccaacattttggctggagtgaacaaaattaaacacaaggcgtccaccatcattaatgacaagctgggagacgccgaagaggcccagcaccaggttggcacatggctcttgaaccgcaaaaaggatatccagtccgttctgactcctgccaagctggagcacttcagtcccgggcctcctccccctcccccatcatactatgacaaaatcaccggctttgtgtccgctcacaaactggctgtcggtctggtcaccatcagtgctgtgaccgcctccggatactatatgtggaacaaccgaattctgcccggaggactgttcggcaacaaaaagcagccgcgacgaagagcagtgagagctgccaatggagcacgaaccgaagtggttgtgctggccggttctttcctagaacctatcgtgagagtggttgctaacgatctggacaagcgaggtttcattgtctatgtcactactacctccgaagccgagaccgcactgatcgagaaggagaactccgcagacatccggtccctcagtgtcaacacccaaaaggccgacgtcatcaagtcaaccatgaaagagtttggtaccttcctggctactccccaggtggcgttccctaatgccaagccccacgtcttgagactggctggcgttgtgctcgttcccgacctctactatccctttggtcccatagagcagatgcatctggagtcctggaactctgtcatcaacagtaagcttttggctcctctggctctgctgtcccagggtctgctgactctggttcgacagaccgcctccacccccaaccctgcccgtctcgtcattgttacccctaacattaccgctgccctttctcctgcttactctgctcctgaggccatggttgtctccggtatcaacgctcttgccacttctcttgaccgagagcttgctcctcacggtatcaaaactacacatatccgccttggctccttcgacgtctcccacggccactctcaatccaaacagctggcctctgcaatccatgcggatctcattacctggtctgaagatatgagagctgcctactccaactacggaggaacaatggccttcctctacggctgccgaagcacacgaggatcgtctctgaagagactgaatttcgccatttacgattctctgactgtgcgacggcccaagcgagtgtggcatgttgggttcggatccagaatgtacgagctggttgctgccttcctgccagagtgcgtgctgtcgtggctcatgcgatccggagctgctcttagaaaacgatcctttgacaaggaactgaatggtatgtaaatagaagttgtagtaatgatgaaatgacagatgttaccctgcactcttcatgagtgtctacttataccgtatgttctcggctgtgtaagcaagttaatctattggtctctatacactattgcacgcttaaagcttagccttgacctcctcaattcgggcggcctggtggtctctagcagctgcctgtcgagcaacgtctcgggcctcctcctcatagtagttaatacagtggtcgagcacaggagcgaacatggtcattcgcatctggccgtaggagttcttgccaacggagtttcgtaccttggcaacaatctcctctacctcgtcccagccgccagcagcatcgatgataccgtccttgagagcctcggcagcggtgaatcggtggcccatcatggtgatctttcggccgataacgggaccgtactggtgggcgtggatggacatgagctgtccaatgagaggagcatcgaactcgatctcgttcatgcagagccagcccttcttgtcgttctggaccttgaagtcgtgggagttggccaggatgaaacctccagcaaaggcgtggccattgacgtaggcgatggtgggccaggggaattcgagcagagatcgctggagtcggccaaggtatcgctcaaagaaccgatcggtcttcatggcagcctctagatccagaccattggagtagaacttggggatggcagaagtggtgaccagaggcttgggctcgtcctccttggtggctagcaggtagtgcagagcctcaacaaaggcgtcaatgaagacgttggacagccggttatccttgggggagtggaactcgatgaggtagtagtcctcggtgtcgtagagactcagcagcttcttatcgtcgggttgggtctcgcccttcttgggtagaggaaacgaggcaaggagtgttcgttcggcaggcattttgtgagtgtgaacagtcgattgaaagagctgattatctgcggtaaagtccaagagctatatatccaatctgaaaatggcttggggcaaaggaaagacaagaaggggtggtgtgcttctcccggttaaggtacagccaaagttcgttcttccccacagatgagttttcacgtggggtagatgatccgtgattttgtagctactggaacgccgaaaaaaacaaaaagggggtatattgacttcaatcaatagattttaaaagcaacttttgccattatatccatcctcggcacttattcgcatctctcccagacctttactgccgagccgaggagcttaattgtccatatccaacttaaatcggtccatccacaatcatgcagcaacacatcataacggttgccagctcagtatcttacagaaggcagcaacatataccttgtgtctatttatcagatgtgcagccttgaattcttcgtcttcacaagcggggtaatatcggaccacgatctttatactatctcggcattaaaacggcatagggttgcatatggccgatgcgtggggttcatggtgaccgaccctcatggcacttatgataactgtactacaagtacaggctattgctatgcggaagtgattaggggccggttcttcagatagtatagattgaggtaatgttgcagctgaagataaaatacgtgtataagtacttgtacaaaaaaactaacgacccttgaccaaactgtttcagtttgttagtgctttgtctcttggcatctaacggtaattatgtacgctaaataaccgctacagtcttgagactaattttcacgcgaaagcactggattcaagcagaacagagtcttacactgtgaaaacatactccagacctccacagtgtcatgattttgtcttttactgtatatcaacctacaataaataccacagatgatgttctaaagtgtcagaaatctttccatagacttcgctcatactccatcttaccccagacaatcatatttcggcacccaataaattactgtttggttataacattttataggttacttgagcaaaatggagtgcatggcgagacggaagtccagtgtcaaagttcacaagattatccgaggcttcttacaatctctgagtacgatgttacagtgcatcgtggctacagtatataccatgcactgtcggacgcaaccacgcctgtcggcttcctttctcgaaacccaatcgcgatggaaggctgtgcttgttcattctgtacatacgatagaaccattcgtttgtattttaatagaagttcctgatagataaccttctggtgttgtggtgttgttattattattacttccctataggtctattacttggctctcctagaagcccatttgtagtccatgggagtatatgcccagttgtatccagtataagtacgcaccataaggcatgcgcacacacatcattatcgtcacaacggctctcagcagagtaaggcaaaacaactgctacaccacttctaaatacctcgggagtgaagtttcagaatcttgtaggcatctacaaacattcattcctgcctaaacggttacgacgagatactctagatacaaacacatatacagcacaacctccaagttgaggtatcaataaacagagcaattgcactcagtttactacagtactaggaatcccacttagacatattccagttcaattccacaccgccgatcctgatgggatgagaaacaaacgacaggttcccaaactgggagtcctcttcttgaagaatatcggtgccctggagcagttcgctggtgagaactggagcatcgatgtaatctgcggactgtcccagcttcctgaggtaggccatcactccagctaaagacacctctaccatgtaagaaccaccttcatgtgtttgtcttaaccgggagatcataagccccagagccaaaaagtaacctgcggcatggtcaagcacttggcaaggacatggtttaggcacacctagatccagtccaaagtattctccctctgatacattcattccagaagctgcctgcaccagcgaatcgaaccctttcttgtcatgccattctccaagtccatatgcactcagagttcccacgataatgctcttgtttcttgtatgaatatccttgagtggtaaacctagacgtttctccagcgacccaggtgcatatgattgtatgaacatgtccgtctcctcgatcatatcccagagtgtcttcatatcttcttcattctccaagtccaaattcactcttcttttacccttggtgaactcgacatccaattctggtgctgtgggaagattgggggacgtgacccacgtgttgtctgcaccatgggcagccagtactttaccgcaaactggggcagcaattactctgttgagttccaataccttctcacctgacaaagcaagtggaccattcaacggtatcacagaagagtctcctgtcttggtgattgttacagggaaatcaagtaagtccacatttttatcctcgtcccactcactgtagcttctcacagctgaaacgggaagacgacgtttagctgcttctgtctcgaagtccactgccttccatttaagcaacgcatcagcgagttctgctttcaatactttcgggtctctggagaccatttcttttcctgttgctagctcgtagcttcccttaatgtggtgggtgtatccatcatggattctgacccacccatctctcgtcttatgatgtcctccaattggatatagcgatgaggagggaatcttctttccatcacaggtaagtagttgttcactatggaactctgcaacactgtgtaaggtgtctacagttgcgaccttgttctctgtagacatcaactccagcgacactgcagctactgcagctatcaggccctgtgccagcgtggcaatcctgaaagaagatggaggaccagaatattggtctccaatcagcttgactttgttctgcggtagtttgaaacggtttgcaatgtcattgaatacttccattgtggtgtaaattaataatagaaggaagacgcgtgagcttcatgcacttcatgtgcatgccagttggttataggatgaaacttaatttacagtacatggagacccagcgaatctgtgccatagactgtggtaacaagagctatacgatctcggaccgttcgatacacaattaatattctatggatattaattaatcatcgaatacgtgcagtacttgtagtctatgttaacattggttaaatccatcatgcgttggaacttcctattgtgacgtgtgtatgtgagcgtactatatggagacgcgacgataatatggctctctcgaaatccggtactttatgcatttgatggtttaatatgtgggtattagtgtctcggggtcaacgatatgaaacctattggattggtagacacgcgttttctcgtatagccaagcttgtggggattttccagactctggtacaatgtgtacgcgcgatacccttgggtccgaccagtcgctgttccactttgttggggctatcttatttatgcactttcggttcatgtcttaaccggcataatctacctaacaaattcctggttagccttcaatatccctacttgtggtgttgtcgaaccatactgcatgtgccaggtttgatagagacagtagcaagcgtaaaaggcggccgaggccaccgagagaacagcgtagcagggcgcgtagtcaccacaggggacgcagaaccaaaccaatgacgaagaagaaccacaaggagacgttttcaaaggcaatgcaaacgaagagggcaatggaaggattgagattagagaactggagactggagtggcgttttcccgatgaacgaacaaacacgcgaagctatgtggaccaacatacaacacggactgaaccaggtttttttatgatttttttactggaaataggtacgtgccaagttggaccatgacactaaacgtgtttaattagtaatattcgtgtaagcgtacattcatttcaaaggttattctttcacagcaaagttataattaaatgaatgtatatgcagaaaaaaaaaaaaaagatattggaagtcatggcattaaatggcaagaatttgcaatgatcggttttgggtactgtgtctatataagacaccatcagatacaccctctagatatccaattatcaaccaacccaaccaacaatgaaggtccagtctgtttttgtcttttctcttgctgctatcgccgctgcgttcgaggcaggcatcactgatgctgacaacatgcccgttcccacccccgttgagaactttggtgaagagatcgttgatctccctctcgttactggagagagtgtcattgacgaggctaccaacgaatatgagtacagcgagggcgactatgagggtaacactaacgaggagcttactgattacttcatgcaggactatcagggagatgccgagaaccccgaggatatccacaagctgattgaccacatcaaggagaagaagtgccccaagaagaagtgcctcaacaagattgttaagactaagacctgctacgtcactctgcacaagctacactacaagacagtcaagaagccttgtgccgtcccgaccaagcacctcaagaagcccgtgaagaagcaaccctccaagaagcagcgatgccccaactgtggatccaccaactgtgatggcggcaaccaatgtcccaacaagggcaacaagggcaacaataagaagcagcagagcaagaagcagcaatgccccaactgtggttcagtcaactgtgatggcggcaaccagtgtcccaataagggcaataagggcaacaagggcaacaagaataataacaaggcccagcggtgtcccaactgtggagacactagctgcggtggctgctctggaaagaaccacaacaagtgccccaactgcggttctcgaaattgcggtggaaactgttagattattttgtaagcgtttattttagtgttaaaagattaattggtgtaagtttcgagtaggtcccatactgtgcgtagtaactactgtaccctcttgttgatgcccgtttggttgcaactatttgtaaaaattgtagctacagtatttgtccagtatgtacttagcatgtagacctcgtatttctgttgcatgacactccagagagttggaaaaaggagatcaaactcaaaataatccaactacaagtagtattgggtttaaaattaagagacgcgctgtgaactaaatattcaattgcgtgtctcaacttacaccatagcacacaacactcgcctcatggacatctttctacagaccctgttgggttctgtcatgctcaaccagcatgtagacgaagaaagctcatactacgagtttttcagtgggtggatctctcgaaaccaacacaagtggggggtcatgaccaccagagcgtatcagaacgcagtgggaagatcggaggaatatctgctgacaacccatagacgtaccgagaagaaattacagctcgaaatttcggaacggtccttaccatggctggttttagcatctcatgtgctcttggggttcacgacagacgcagcccagatctcagaactgatggtcttctgtgggttcaggagagtacacgagaaggttattaaatcaattgtcgaatggtcgacgtatccttcacgcctgaacatgggcgacacatcccaggagtacacaattacggcatttgagaatctacagaaagcattctcagagggtgacggtagtgaaagcataggatggaggcgactgggataccagaagctcatgtggaagacgatatatcaacatcatctatcgacgcctgatctcaaccccatgtttaacaccgctggcattattttctatggtctgatttcgctggatgatgaccggtatgcagtgctattcatcgatgcagtgactgaagcattgcagttctcacgacaattcagcgccaacaacgaaattgaactagctcagcatattgctgataccatcgctgcatacatgaaggagtacggccatccctggtactttattttgctcaaccctttgcgaggctggctacactcaaccatgtcgaaggcacttggcatgctaactgagccctcagcttgtcaattcattgctcctcgacagctcaccgccaatttgaaactggtccccacaaaagtagaagctcttctgtcctccatccagcagatgctgcaagatgaaagcatcatgaaggaatacccgccgttcagtctggtcgaatacgacggcccatggcctttggtgtttgttgagaatctgcattggagccagcatcaactgagcagcacacatcctaatgtctttgaacaggtttccaagaacaaccccgaattgaagttcgccaaggaactgcgggtcgtagacttgcccagtttggaaacaggtgaaattagccatgacagtttcgaactactaaaatgccaggcacctagtggtgtcggacagaatgagggcattactgacaacgctggactgcaggatgagctgttggataggaactttgcatctctcatgaaacgttcaaatgagttcaatattgtacctgggagggactatcagacttcaccagtagattacatttccagaaagatggttctgcacatctggcaatgtttcaagcttcgagagaccatggctaccaacggacaaacgcgaatgttggattttgacgacctggttcacgtgctttctcgtggccatgatgtctataaggtgattaatcatgaggaggcactgtggcagtccaaaggagtcgagattgcccatgggttggatgattgcattctcatatttattggagctgactcggccattcaacaagtaacatggtgggaagaaggacgtctgggctgggatgttttttctcaggaatcaatggtgagtttcctgcccaagactgtggaagaagccgttgaagaaggcgggagacgtgatgcccctattcagctgtctgagtcagatgatgaggaccctgtcaatgctaaagatacgatgagcacccccactcagcgacgaagccggagagttagagaacaggaagttggttcggcggaaactgaggaacccaatgggtatgatttcgattcatcttctgaagacgacctcgagaggaccgtatctgaccctgcgctgcctgcgcaagcccagcgacgcacgtccacccaagtccctgctcatctcagaggcctctatgacagcattgaccctgctatgagagaaggcctttacaacaagaagcatccccttattagaaatcttgtcaagctgattcccaaactatcggaccgaaatatgacggaagactcaaggccattttcatacgatatcagagaggcgttgggccttgctgagggggataatgatgttgagacgaacggaaactgagatggcatacggtggcttaaaatgcaaccattatttattcatatgggtaggaaatacacaggtctactcaaatcgttaacaatacaataaatcaataacatacaaaagcgttttatagttcgccagagaggatggcctcaaccacaaagttgatgtagtctctcttgggggtaagcgaacagccaaatctctcctccagcgaccgtcggatactcttcttggtgacggacatgagatcagctgttcgtaggatatctcgaacaccttcagtgatttcttcattggaaggcaggttgtgggacatgacgggggcaggatccggagtggacaacagacccaccttggactcgttctgatgcattgacacttcgtccatgaaaggagagtcatggtaagcatcgtaggacgacatctggtcaaagttagaccgtcggtcgtactgctcatggtcgtgcagatcatcctcctcccagttttcggcctggtagtcctcccatcgctgcatgggaatctcagcagggtcaaactttccctcggagctaagaatcatcttcttacccttctctccgagaacaacacgagtgttaccccaagagaaatcatccatgtgccagaaagagtacagtgggatggcaagggagaagataggaatggcgaggatgtaaatgaacatccatccaatcatttcccatcgtcgtcgcatcaagaaaatgatcgcctgcagaccgtagatggctccaaggagagcaatggatgcaatgggaatgttgttggggtcactggccagtcggtagatgaggtagacaatgtagccaaccagcacgggctgcacaatggtcgacatgagatccagaagaaccacaaatcgcatggagaaacagcagaaaccacacagctgctgcatgggcaccagctccatcagattgtggacagtggagttgatccatcgtcgtcgctgagacaggaagacggaccaggtatctggagcaaaggtccaggcctcggcctctcgaatgaacttagtcttgtacatggggaagtgcttgagcagcagagtggtcaagtatcgatcctctccgagatgcagcaggttcttaagatgcagagtgtcgactcggttgatcatatagttgtgaacaatggcgttggacacaaacagaggctttcctgtgtcaagttcaacaatcttgtacatggagaaacaaccaggcagacatgtgacacttccaaacagggactcaaatgccttcgccatattatgcgaaatgtagtactcgtagacctgcaccatggtgacaatggtagacttcgcgttcgacagcgaagtctcaccacatagagcaatgatacgagtgtcgtgaagaaaggcggagatcattcgagtagcagcatcgggagcaacctgggtatcggcatcgacctggaacaggtactcgtaataagcagggttgacaccaatgacattctggatctggtggtacagctcaagctctagagggttcatgggaagaccgtagtgaactcggttgaggaaccgcatgacaaccatctgggagtctcgcttacctcgattaccgggtcggttcacctcggtaggtcgaccaaccttgacgacaacaacaaagggcacgatatggcctccgacttcgtaaagaccactgaacaccttacccatgttgtgctgcttgttgccctcaccgagcgactcaaacgatagggcctgagcatcgacctccggaggaacaccgagaatatcaagcacaattcgaggagtgggtcgatcgttaccagcaccgacaatcataccatcacaaacaacaaacagtagctttcgcttatcgtcgtacttggaacgggcaagcgagtcaatggctcgtcgcaaagactcctcgtcctcagtgtaggcggggatctggcaaatgtagaacttgtccagatcctcgggcttcttgggcttggagaattggagtgcggcaataaacttgaaggcaatgacggcaacaaggaaaatggaaattgccagcaggaagtaacgggcgaactcacactgcacagagtgtcgagtgtcgagcttgccaacaaagaacaggttgtcaagacagtccttcatatcgagttttccatttccatcaagctgcatgttgtcccacttcttggttatatcctggccagagtaggtctggaacagattgacaacctcactagcaaggaactgagtgtcgacgtccttgttgacagactcgccggatttggctcgaactcgcatatctccagttacatactgggtaaggtcgtatacgttgttgtgcaagtaggcaatggttcgctgcttaccggcttgctccttgatatgcttggaagtgataccgttgtagcccttgaagaagttgattcgcaggtttttcatctgttccatgtaccagtcgggtcgagagtcgttttggaacgatcggaagtcgtggtactgggcgttctcatcggtatagttgttggtggagcccatgacgagcatgtcatcaatggggccatttataccattgcacacggcagagatctgaacggggaaaatgtcagaggcatccttaccggcgtacttgagaacagcagaggaagaaacaatgggaggataatgaccaggagcaaactttgtaaggtcaaacacattgcctcgaatggaggtaaaggcctgtttgggatcattgtcaaaggaatgagactgcagctctgcagtggagaagacatgctgagtgggacagatgagaatggggaaaccgacgaggaaaagaacaacaccgccgcaagccagccagatgagcaagttgatggcaaacttttctctccatgcaattcgaacgtcttttcgcttcattcgaccaatatacttgatggctgcatcaggaacccaccaggtaagtgtccaaacaatgaacatccagaactttcgctttccagtcactgctacattctccacaacgtcatcctcggcctcgccaacctccttggcttgcaactcgccgttagcattgtatctaaacatgtcgccagtctgtccaaccacagggtttccgtcctgatcgtagtagaaagcatcctcaggggtcagacccatatctctgttcagaacatcctccatggcgtgctcagtagcatgggatggatcaaccatattcttccatgctctctcagacaaaaagactcctgtgagaccgatacgagcatctcgctccttccagccgtggtgacccacgatctgggcactgacaactcggtcttctcctccctcaaacgtatcatcatcgtagatctgctcctcattcttagccagagcaatgaaccgggcaaagggaatgaacatacccacatcggtggtcttgactcgctgcgtgaactcggtgataccaaaacatttgatctgctgtcgaacacatcgagcatcaaattgaccggcaattcttcgatcgttgggtttcagacaaatgacgaagtaaggattggcctcttcaaacgcgtccgtgagagcctcgacggaagacacaaactggccacaggcgtcgtttcgggccttttgctttcttcggcctccattggcgtcttttcgtcgagtcgactttcgtaccaaactgggctgtcgagcaggctgactgttgagagaagcctgaacatactcgccaccaaagtccttggaggcatcggcatgcacagcaccagtgtggaacagctgtcgcaggaaaggagaggtggaatcactagtgaacacagccactgtgtctccagagatcgactcggcattgtcagcaagaagatggtcagttccatactcaacctcaccggcaaaatgacgaaccaggaaagatcgaggcgaagagggagactccacaacagtggacttagaaaaccgtttactcagcgagtccagaagctgactgtctgacttatctcgtcgggaatagtcgtcaacaacagaaagaattcccaaactaggtttgaatagagcccgcacaatgtcggagttgtcaaagtactcggccgtaggcaccacgatgtcctcagactccagcagatcagtcatgttctcaaagtagatggactggacaaactggtagaacttttcattggcggcattgtgaagaagacggtcgagagtggggacggcaggagacacgttgaaaccggggaagtccacaagagtgatactggtctcgaccagggtgttctccttgacatccccggtgctgtcatcctcagaggtctgtgagagtagcacgtttatctgctcaagtacccaagagaagagcatggcatacaggcaccgggcaagagtgtctgcagactctcgggctcccttctggtcaagaaccagcgtgactcggtcgtttcgcatcatcacggtcttgtacaccatagcgttttccagcacggtggttcgcactcccaggaagttggccaccaggttgagttcctcggggttggcaatttcaacagcaggaccgctagtgccgtcgtttccagtggacttgaactggatctgacctaggtgcaggacagctgccagaatctgagacatgttggccatatcacttctggagaagcccagggaggccatggaacccttcagatgggtgaatcgctccgcatcattgatgccagacttgacttggctctggtggccgagatatcggaaagatcgggattcagaggggtcaggaagctccagatactctcgttcggttgcactgataccagcgaggaggtagtagaagacatggaagtttctttcggcggtaggcacctttgtaattcgagacctttcaagtcggtagtccaggaaggaggctccgatcagagtggagtctgcggcgtactggagttcggccaccactccggctcgagaggcctgggttgaggtgagtgtcttggagcaggtgaatgctgaggtgatgaattctgcatttttgatcttcgttgaaagggggttgttggacagtgctgtgttagtgaaacctttgcaactgatgtgtttttctggcactatgcatgactctctccgactccttgagtcatatttctccctctctctcttactcactcaataaactgaaaagaatgctgttcttgaactcggtcttgccgctaccactctctcctaggaatagaaccagctgagactcaccccgcttgaccattcggttgaagatctgaatggaaaaggcgttgagaggttccttgcgctgctcgtccatgggggtgtatgtgttgatcatgaccagggttcgagacgaaatggtagcaaagggcatgccctggtggtatctggcggccagatgggaggccagacccacatccgacatggccgacgggggcaactgcgacaggtccgtcacgtttgcggtcatctctttggtagtagaggcacaataagcagcgtagctgtcgggtgtgtgtgtgtgtgtgtagatgtgtagtggtagtgtgagatgaacctgtgcagctgtatgctgtaattagaattactgtgtgtccttctccaggcttagtcccgaaatagctaccaaataatagtctgtagcgaagtgtaatttgagtgtgtgctattaataggtgtttttgtgagaccattttggagggcaatcgaaaatattgttacaaaaaagaggtcacatgacactagtgttcgccctttgaccagaaaatatttttcccctcgttgaaatctgcccaactcgtcatattgatgcctcctgttgtatacgctcaccccttttgcactctacagcttctgcccaaaacacgagaccgaaaccttatttctgtttgatcgcgttaccgcggcaacgagtagtctgtccaggacgctttgggacatggtcaaacacaacaccataagatcatcaaaacagatgtgagtagtattggggtttgaaacgagagtaagaaactgctacttgtaggactttccaatactccatcatgtactctatattccagaaaggagactcttccctaaccaaaccactgacaaataacgaaaagcggttagggtaaacaagcctcatccaggaacatctcccatgcaagattcatgattagtaacgtgtatgtgtaactgagggaattaaaaggagttgactgatgcttgctttgaaagaaggtgtttagaaatgttgggttacaagtaaaagtattgtacatacaagtacagtattattttacaagcggatcagctgtttactgtatgtcttccgttgagcaatgtacaagtactacttgtagtatggtgcaacactggctttaaacctgtgatgatacatgtacaatttagctgttccaaacaatggcattatgaacagacatgacaacgaaccagatcgcgggtgaaagagataattctcttactacaagtgcaagtacaagtacggtacaagtataggtacctgtacttgtctccggggcggttcacataatcgacccagaagttcgctgagccggtccagtagcccgcatttatcggacagttcatctaacgttatttttacggagggtgcttgtgctctaaaaaagtggaggctagcgagtaagaaattaatccaagctaagtacaattacgtaataggcctggtttgaggaatattgtgtgagttaggaggggctagttctagaagggcaggtaggataatatcaaatacaattggtcataattgtgatatattgggcgagtgggttattaagctttgagacgatttggaaatgtcatgtagagggctaagcgtggatgtcacacctcagctgaaccgttgaagtgagaggcagatccagttcgtctcagtggatatcactccaatgacacagcatatgttaatcacgtgacaattaattgaaagcaacatctcacaaagaaagaaagttcttaatggcgtttttagtgaatgcatcattgtagcaaggccaactggtgctatgctgtccataaataattatcacagtgtgcacagcacaatcttcagttacagtaccatattgatgaccaacgttcattacttcattacagtggttcaattgcttctcatctgtctgcctgttatcatttcatacggtagcagctctacagcatacaggattacaagatggatcagataatgatgtgtattaatagaggtataaatattttggttcgttagcacttgcaagtgtcacaggcgcacttagtgcaagcacaggtggccttagtggtggtggcattgatagagcagccgcaagagttgtggttgaccatagaacgcttagagtgggtaggcttgggggcagacagaacgctagcgccaagggagacagggaaaaaaagcattgaagtgttggttgaatgtgagagttggaaggggagagtgtgtgaagaatggtaattatatatgggtatctaacatgtttaaatacttttctacaagtctaagatcataagaagtcatctccagtggcaaatttaacgcggtctaaattccaacaaagttattcagccgtagcgaattcctcgcaaatcgtgcatgatagacgcaaccaacgatgcggagtccgaaccgagggcatctgacggccgaatttgacgactacttttttttcttcttctcgattcggaatccgatgaagcagaagccccgtgacatatccatccctttcctgtagttatatgacttcttgtacatgcaagtggtgcttcgaacgatagctacattaattacacactctctccaaatgtgttaaggattatccagccatattggatcctctcgtctgtaaatcattgcgtaccatctaataacttctgacaaatagcataactggctcgcaagtgacaaatgtcagccattgaagttacacagcctcgccgcagccgttccaaaaaggtataggcgcatctcggctattgtacgccaagtcgaggacaatagacatttcactagtgcaagtgtcagaataattttctggaatggtgagattatggcgtgtttagtggaacagagtccttattcagctagagtacacttctaaggaaccactgatagtggtacagttgcagccagagtatatatatatatattatctgcgcacataaggaaaaagaatgtacggtatgtacaggtaccgactcctatactgtactgtgtgtacatactgtagttcgtctttttaaattagcccattctggattgaaagtctcatcaatatgtctaaggacccaaagacgcaagtgctcgtacagatatgagcgtctggtacgagcacgatgcagtagctattacatattctgacatcttggtttatcgacgtgaatgtcaacataccttaacattttcagattatctgagcttagtcccaagataatgggtattatgtatcgagtctcacctctaccgcggtacatacatactacacggtgtacaagtgtacgagtacatctaaccatccataatattattttacctactgtgtggtacatacgagttatctaccgtaggaactgttaccagtatgcacgggatgtactcgtgctcgcgaggatcaaatggaggtctcacacaccacatcaagccgaagattgagggagtggcagtaggagcacaaccagccaaccgcatcacatttggtaacaaatattatattaaaaccagcaactaagtatagaaaccattccaccttgtacaatgacatccaagacattggagaaacacgaacatttgtagtttgattactgtctctcattgtcataatatcccttaccaacatacaactccccatcaacagtccaaattcagaaatcacgtgtcgatataacctctctcacagccatttccgtatccaaaaaacgctcctttgaccttgtcgtgtacacttgtacgtcgcccaatcgaatagggcccaaactcactccaaggccatattaattaacgttcgggggctgctctgggacgttaattcagatctcgacccgccaaagaaacaaaaaagaacaaacaaacaagaaaggtcaaggttagagatcgagtcatatggtgcatatattggaaaattttctgtggggatagctacaagtagctacagtaactacagtagctgtaatatactgaatagtaagtcacagctggtactgtgtgaactgtcgtccacactgatttttccagaaaatacatgatccataccgtttattgtaacagctcgccatcccacatcaaaatacacaataaatagttagttacaaaattctcacactgttggactcctccttacaaccaacctcctccttgtgccaaatattctcgtgcgatgttgtctccagccttggcggcacatcgcatccaatgtcgaacaatggccatccgagtagggtccaacttgtccaaatcagacgtagaacagttgggcatgtcctcaaacagctcattcagccgggtcagaggcatgacacacaggttgacctcaccagggtgactcagttgcatgattccaagttcccgctgagccaccgagttaccttccttggctgcaatggtccatagctcaccacactccttcattccaaaaccagcgagcggtgaagagccgttgaaagaagactgtgtgcgagaaacgtcgctgctggtagactggaagatctcgttagctgcctctacaatgcattccacagcctcgtgcttgattgaaagagcagctagcacaacgtcccagaacatcttgccagagtaagacaggtccagattgtcgagcggtgcaaaagctgcaatcatttggagatctctgaatagggtcttgggacgcaaatcggagcggaaaagactttgcagctcctccacaatggcgtcggctccaggatcagaacgcgtgccagcagtcagagcggcaacaaccagtgtttcaagctcatataggcactgcatcttggcatgaggcgaagtgacagtggagaatttggacagaatctcactgtaggcccggtcgtaggggaatggagcagacagagtgttgctgcaaatcgcaccggaaatcactggagtgatacacgagggtatggaaatgggaattccatcgggcaggcgagcctctactgcagcactgggggtgttgggaagcgtgagtttaaacgtaggaggcagaggcgacggggtagctgtggcagagaccatgttctgcgcaccagctcctgctgttccgttggagctgttcactttaacgggcgtgatcggtgcactggaggcgctagtggcagctgacgggggaagtgtcagcctgaaggcaccaccctgggcgttgggtcgcatggaaaaatacgattcagtgggactggaacaggtcttctggggcgttccaagatgctcgcaagaagttgcagccgcggtggacgccacagttccaatgctcagaatcgacgacctgtgtctcagagctcttggaggggcatgtttcacggacagacaagcctttacaagatcagaagatagccattggtcagtctcacttccagaaaaccacccagaaccaaggtcagagtaaacaatggagaccaagaacaggtggagatcttcagagcattgaggggttctcttctcagggaacagaggcgagcctccagcagccagctcggcaatgagtcgctggcaaagatcatccacctcacagtagaatctgtgcagtcgctcttctccctggcagagattttgcttgcgctgctcctctagccatcgtcgcgtggcatcactctctctgtcggacaacttgtttggaccagcaaacgaaggaggtgcaaacatggtaatttcggaaggcagagagacgatactctgtcgctgtcgtcgcttgttatacccaagagaaagccttttgaagaaggattctctggaggctgtagagacaacggaacttggccgcctgaacttgctgtccagtcctccaaggctgcccatggcggcagccgggcctaaagaaggcgtcgaattgggatcagccaacttctgtgcaacacaggaggctcgaacgtaaacctcagagttccgaacctgcgtcacgtaccacaccttgttccgcagagtgcccatagccttgaccagctgagaggtcttgtcacggaatctctcaatggaccgattgtagaggcacacttcagtctctagtcgctcacattcagttgtgtactggtccagctggacctccagggcacaatgaagggccacaatgtcccctgaagtaatggaggcatcgtggaactcctgggcctggttccagttgccctgggacagttccttcgcggaagcttgggcgagaagtacagatacgtcctccgacgaagtgtcatagtttctgataagctgatgcaggggtgaaaagtaggtgaaggcgacggtgtggggatcgatgttgaacacgtgccaggttgtgaagttgcgcgggcaggagattcccagtgatttgagctctccaggagacaagaccacgtaggaggggttgtggtgtgttctgtagtcgaggtgctgaggcgttccagacgcgaatttgccaaagatggcgttggtggctcgggtgctggggtcatggctcagatccacgagcttggcatggatgcagctcatctgcgatctctgtgctggcgagatgtagaaatcatggcacatgccatactgttccgggttcaccaacatgtctttcacatagacgctaaaatagtactcggcgattgtgtgaagatgcgacttgtccagcgcacagagagagttggtgaactgcagccactctgaacacaagtaggagaactgacccaggtgtcgaaggattgtggtggctgcatcgacgacgctcagatgcgacgcctggaaaatctggagaatgagagtctctagtttcgagaagttgcatgtgttatagttgttgttcaggaatgcaagcgcctgagtaatgaaggtggaggtagggagagtggtagatgcagaagtagtgtttgtgttgttagtggcggtagtataagaccgtggggtcgatgcatgcaatgacttgttttgtctgtgtgttggcttgtgctgtggctgttgtagtgaccgtgtctgtgtcgttagttcctgtccttccttgtgctgacatgctgcattgcacaccgcggccagataagccatgtcggtgtccaccttatggagagctgcgagggtgacgtacacatggcgagccgtcgagttgcgggttcgcagcaggtctgcggccttctgtactccattgtctcccttgagtctctgtatctgggtccatacttcgatctcctgggtgcccgacagctcgggttcgggattgaccgaagggcgcggttccgccgcatgcgccattattcttttgtatagctcgtaaaattcgcgtgactcattctgaacttgagagtcacacagtttccggtggttggcaattgtgtcgtagtatcgtttttgagcgtcaacgtttcgaagagcggccttgcgcagtcggtagcggagcttgagtgtcgtgtcctcgtagagccacgttttgtggtccagagccgccagctcagctagcgacacgccgttggtcgtagagtgtggcgtagacgttgtagtagaagtgtgagagctgtgcccgtggatgcggaacactcccgagtcgcgtagagatgtagtgacggttgtcatctatgttagtatgagttgaggtggcggtggatagctgccgttgaaatgacaagacccatgtgacctaagcgaaggtggcgggctgggagtgcggatgacacctgcttgaatagatggtagatgagctgagaaaacgacagagatacacgtgagggttcatagaacacgtatctttctgtcttctaaccttggtactgacactggtcgtgtagtgtgcagtttcagaagcacattttctcctactcttcatctcttgtacatagtcatgtatctctgagtcatgtggactcagagagtgagcctcatcgaatgcattatcgcgccttgacgctgtcccggtgacgggttggcttcatttagacccccttctgttcgcaaatactcacattcaaaaccaccttatgccatacccatggaagaagaaaaccatgcagagagaagaagagattggcgataagtcactacaccactatactcctctccaaactctctttgcattaaggtatctacaagcgtcgaggtaaacaccataaggtttacttacctttgtttgtccctcacacggggtgacgaagacatgcagctaccatgtattgtgtaaatgagtgagagataaatggggcgatttaaccacggtattgcattagcgacaagtcgggccagtatgggatgttattttcgcagccaatattataaagacggacactgaggtttgaaaatttttcaaaagtttctccgacccaagaatattttccgtggctctgtttttttctcttcgtattgtggggctcgtctttcttagatagcccattttccgggccccgtactttcgaaaagctcgcacctcatttaactcaaaacagaaagatgaatcaggcacacagtggagcctgacactcacagcagggaaacaaggtgggctgcaccagtcatgcagctggggaatgggttttgggtacggttggtcgcaattgggagcagaagtggccttgtcctcacccgcgtactgagacaagtgtatcgccgacgtccggtggcctctacagaggtagtttgggggcagtggttcgacacatgtcaccgtaacatatgctagtgttttatccgtagatagcatggagatctgtacacccaccggtacactaaattgcaggtcgccttccaacaagcatgcagcctaacgctcaacctgtacaaaagtggtaacgtagcgccgactgataagaaaaaaatgcatgaaccttgaccctcccagctgtccgtccagatagcgggggagtcccaatgcatgcgtagaccaataatcttcaccttctgggagcatatacatcagcaccgcacttggtaattttgcttggtgtaatattggcaaggacggatatatatttcgcatccccgctactgactgggactactgtatcccttggcacacgtcatgtttcaaaccatatacccagctaatggcttggaaaaagggcgtgtgtggggtgtacactataaataggctatagagcgaccccccctgtatagtggcattctgatgatgtcatctctgccaatattgaaactgcagcgcgtgtgagtgacagaaggaagcgtctcccacccatatggcccctattactgctcgtattccgtccaaacggatggtgtgaaataatttctgcacgctagtgctcgagagtctacatggtcaggggcgctgaatgtggaagcacgtacaccatgtcgctgcaatacaccatctacgacacggcattgagtgacatttcacaataatttgcaacacggcattaatggagctgtttgttgtgatgcctacaagtgtgtcactcgtattgacagggtcaatgtcttccggtttaagaaatagctaatggtcatgggacaacctgtgtgcaagacactcacacgtatgtaggtcctcgtacttgtactgtagagcattttgtaaactaccgccattccagcctcttgccctcttcttcggggatctattcttagcgcactgtctgtggtggaccccaccctgggcgggaataaacaaacaagtcatggcggccctacgctcgtaatgatacctcgttttgggagcttgtggagatgtgttgctaacggttataggccatctgtatatatccacgtcctgggtctcatgatttttcagggcggaataattatctacagtcccagatgtctgttatggaatgaggcttggatagctcttaagcgtgggcgagcgttggaaagacacattttgggttgtgtcagaacaaagacataacaatgggagaaaagcaaaaaaccaaaatatgcaggaaagaataacatggccaagccatggttcatcctcgaacccctgaactacaacttgcggcattgtcgatctgtacatggccagggcagccgtttcgcctgtgcactgaggctgaaacaagcacagctttgatccaattattacaagtataggtactgtatacactctctaacttgcactacatcatagtgtaccagtagcactaccagtagctgtcgcgctaaagagctgatctagcccaatgattacacagtgtactgtagagctcttgctggtgatacgaaccaaggtcgtattaactgtcatgctgtatgtacagcttgtctgcttccggaactgtgcggagcacagccaaaccaataaacgggtcatccggacttcaggctgcttcaaggcagtatgaagaataataaaagcaaaaacatcagctgccctaattatacccctgctgttgacagttggacaactggcccggtggtaaattacaagttgagggttttagcgcaatttcgactttagaacattggtttttggctgcgtcattggacactgttaacagcaactagttccacacaagcaacacactggacaagtgccgtgagttagatagctcgaacggtatgtcttgacgctaaatgagatatcaagagacttctggctttgattcaatactgacgatatctcaaaacctcgcctatcgctgtttctggaatagttggaccgactgggtaaaaaagtagtggttgttgcaaaatctcctctcatgcatgcagactaccccgcgtttcttttagcgaagagagtttgcacaactatttcttgtagctgctgtgattactgagtccgtcatgtgacttttacaagtggtgatatctttgctacagaacttatgatgctcacaaccgcaatggatgttacattgagtatgcaagtcacacgtggccccaaactcccctgttgccctagaccgcctggatcatcacatcttcctgtttcacgcgtctcgtaggtttcaatatatgcaagcagatcaaacccacggcagggctgtctaaactttcgaaagtacgctgtagctgtaggtgacgaacgcctatcaaaagtttcacagcaatgacaggcacatcacatggcaggttcattcataaagaagcaggcgcgcagacgatccccacccctgtccccacgttttgctctgtactatcgtgcaagttgtatcgtgtctttccaagacggattcgaggtcgaatattattcacacagcttattattatacaacaggctcattagaaggtacagacgaacatgaacgtcgaactgagcgttaaaatttttgcactcacgacaaattattgatggcctgactcatacaagggagtaatcattccatgttgcaaaaccggtgttaaaagaaataaaaatataaaaatatacttgtgagcatggtgtccgacgcagcgtagacaacgccgcctatgatgagatttacatatccgtaaccaagctgagaataatgaagcgcgtaacattcatcaaacacttcacacgttcccgttttcgagtttcatacactgcgttgaccctggacttacaaaactgtgtatctgatactgtgcaatttactgtgcttgtatgttcatgagcttagtcagtcatccccaacttcatcctcagaccttaaataaagttctagctcatctcccaaccgttgactactcgtcatacttgtagctactggtacgtagggttgacttttcaaattaccctaccgtggactatcatttataaaagacttttcagaacttttttctctccagagcacatccccgaacagtgagtaccttaacatgtcagcacacaagcgcaattttagtgatgatattaccaatttacatgggctagccttgcacggcaatgatgcttctgttaaccatctttcgggactgatattcattaccccatttctggagtcttttgaacccttctaacttaggtatgagtggcactactggaaccctgctatttagtgaacaaatcaactggaagagacaacctcagaacaattgtagtattatggactgtatctagtggtacttttacttatagtgatattttggtataactatctggatatgaatcagtgccatttgaagctctgataccacattcgtttgtgtcatgtcccacatgccctaactcacgccttggatccatatgcgtgcactcctgctacattagctacttgtagatatcggtccgtctcacgatccaaatcacgatgttacctgcactccagatctaatagttacttataggagctacaagcagctggcgtattctagctttgcatgggccgaatgtgagtatcacatgagtctggaaaactactgtggtatggctgcggttccaaatcagtggcccttgatcatgatcaccatgtctatctacagtaaccacctacaacactgtgtgaaaaggggtagtgtcagaaaaggactgcgtgtaactattgtacataatacagtatcacagtatcatacccatagctgccatacaatttatttctagtaattgtagagtccaagtacatgaagaaactgctcactgtagtagccctacatacctgaagcaccgtttgttgactctcgcttgtccactcactgccgtgtcgtaaagggccattccgaggaaggcaaattcgggtgacctgaacatcaatgaagtttcatttggcttcgccgttgtgttctgagagattatccgggtgtcgtatctccttgaaatgtattggacgtgctacaacttagtgaacctggtactatatctacaagtacatacagtacatgacattaacatcacataaaactagtgtacacgaaggaatggacagcctctactcgtagtccacaaccccgtagccccgccatataagcctttttataagcagtcttagtgggtgagataggagtgaaattccggcagaacaaatatctttggacccgtcttacaaggtcaaaagacatcatctcttagccaaatgactcacgcgagggagggcttgtgccgcgtgataccgccgtggcccactattttgccactctggcagcacgtgtgtgaatgcctggttgtgggacgttggttggttcgagccttatttgtccttttatttcttacacaccctgctggaaaagggtcacagggatagccactccttatcttccaaatggctcctgactcgcgcgacttttcgatagctagacccacggctatagttattcactccctttaccctgttggatcatccccggctccaggggctgtgtgaacacgtccataatatcgtcttatgcgcagttgtaccgtccacttgtaagcctcctctccagctgggagttcgcattcataacgcagctacattagacactttctgctggtcacccccacatcacgtgctcttggcaagtgttatcaaagttaatatatagttggcagcacgcgcaagagcaagtgacttttcttgaaactgagaatcaaaagatatcttcacagtcacaacctgaaacggcgtctcttgggcagcccataaacgtttgccactaacacctaccatctcatctcttttcacacttatctaccttgagaactacccactcgacacatcatcaacgacacgttgttgccacaacccacaatggacacccccctgacacgaaacacgtcgtcggcgtcgctgtcgtcgctggagtacgagcatgatatggaccggcatcagatgttcgattttctcgatcacctctcattgaccacacaactgacgaagaccatccccaccaaggcgcggcaaaaagcgtcggaaatcaaagatgcagccattcgacaacgaaacaagatcaaagggaaccaggacatcgaccgactgcgtcaacagatgatcagacagatggagaagatggagacccggctgggaactgccacggccatcaactcgacggagaaatacaccttcgccattggcctggtcaccatattcttcattggatacgtcatgggacacgcgccagaatatcttcatgtcatctacacggtgctgttctgttttctgatgcccatcagagcgtatacgtaccgaaaaaaggagtaccactactttctcgccgatctatgctacttcgttaacttcctcacgcttttgtacctgtgggtcttccccagctcggagcgattatttatttcatgctactctctcactacaggaaccctctcctgggccgtcatcacgtggagaaactctctggttttgcattccctagataaaaccacctctgcctttatccacatctttccacccgtgctgttccacgttattgtccacgttctggatcaggactacaaggcccaccgatttccgggggctgtaaaggttgagtcgtggaagatggtccagggtctggtatggacatctattgcttacgccatctggcaagcgctgtatcacttcttcatcaccattcgaagaaaggacaagatcagagctggtcgggtcacttcctttgagtggctgcggcgatcctacagcaagacacctctcggtaagttcgtcaacggccttcctgagcctttccctgttgttgcctttactgccatccagtttggctaccagctgggaactatgctgttctgccccatctggtactcttatggctacctttctggctgcttcatgaccttcatcctcttcactgcgtcttacaacggagccacttactacatcgatgtgtttggcaagcgtttccagaaggagctgcaattgctgcaggctgaggtggcccaatggcaggacaccaaccagatgatcatcagccccaacctcatgcccaacatggcccaccccgagaagaagagtgcccagagtgtgtggctgaaggatatcgaagatgacggccatcctacagcctatcaggagaacaaggatgtcagcgacatcaagttgtgattgataatggtttgattcgtgtaataatagacaatgacccgttgtcagggcagtactctccaccctgtgtataccaatacaaacaaaaatgaacgggtcttcatagagtgagaagcttgtatataacgaacgcctgagactttatgagaaagaaggtctccctaaatacagtatttcgggggtaagcagctagatataatcatctggacgtgtctcatgaaatccagcttcttgtggttcactcgtaacgtcttgccaggatcgtcaaacgagatggcttgttggatgtgtagagggcccagcagcttgtaaagtgacttggaaataagcagcacccttatctgtcgagggacagcctcactgacgtccttttttcttttttttcccgtacttttcagctataaccgtgttaaatccacatatctgacccggattcgggggttcagaagagcttctgataattgtgtttgttgattcccttcacttcctcctctggaccagataaatacaaaatatcaaccgtcaaacattgcaaattgtagggaattataaaaaaaattataaaatattttttttattctaatgattcattacagcacagcaaaaaaaattgggaaaaattgttttaagctgctgtagacaaaatcattgtaaatctgcatctctaggcaacctggccgagcggtctaaggcgccaggttaaggctaacaccttaacgaatatcctggtctcttcggaggcgagagttcgaatctctcggttgtcaacttttttggctgactcttctattgacgtcggcttttatcatgcatttgtcttaagtacttctttttcattgatttgaggtgtgttctgtcgatgtcatcatatagtacaagtagtgtctcactaccgagcttcaaatgcttggaagttacgctactgtatatctggccaaccatcgatttacttgtatagtgttatgttgaagaacaagacgctatagacacacagtatatctacaggcacttgtacgcaatgaatggacgccgtatactgttcaaatgtttgatattcagtatcaccagctcacatctacaaatactccactcccacatgccggagccgcacgaacttatgagatcaacttgtgctccttgtacaagtaccggtacaagtacctgttcctatagatctgcgtgatcaaatgcaggttgcacacagaacaacaacaagagagtacaacaccatcaagtgaaatctaatatgctgccacacactgatgagagacaccgcttctatgacatgattgaaatgagttacagtaggatggaaagactggtcgtagctaggtacaaggatgtggggaggtatgcgtttattagttcatagaccacatggtctttccatgggttaatatctcgtataaatgtccaataccagccactctcattgtataccactgctgcctgcctcacgtcccgtttcacgggtcatacgtgcggctgaactctacaacttccgtgctgtgcggctcatcatcaagtagcctttcattctgttgagcatcccgttgtgatacagaatatgatccacatgtccatctcttcaccacgacatcaagtgacacgaaaacgacacatagcagcgcaagatacgacgaaaaatacccagtgatttcagcaagaaatgtacactcaatcatgataccataacgaggtcactagcctttcaaaccaccacctctagatgacatcaagaacgcatcacagtgcatgtcatgcacctctcgtcacccacaaccgggtcaaggactacggaaatccacttgaacgatacccgaagcgtctcggggtatctatataaggcacccatggaaccctgttgattcctcattcaaacacgcacacgaacaaacactatgaaggtccttctcattctctacgacgccggctcccacgctgttgatgagcccaaactactcggatgcaccgagaacgagctcggtatccgatcatggctcgagtcccagggccatactctggtaaccacctcttccaaggatggcgatgactctgtcctcgacaaggaaattgtcgacgccgatgtcgtcatcaccactcccttccatcccggttacattacccgagagcgaattgccaaggccaagaacctcaaaatatgtgttactgcaggtgttggttccgaccatgtcgaccttgatgccgccaacgagcgagacattgccgttctcgaggtcactggttccaacgtccaatccgtcgctgagcacgtcgtcatgaccatgctcgtcctcgtccgaaactttgtccccgctcacgagcaggtcatggctggtggttgggatgttgctgctgtcgccaaggactcttatgacatcgagggtaaggtcattggtaccgttggtggtggccgaattggtcagcgagtcctcaagcgagtggctcccttcaaccctaaggagatgctctactacgactaccaaggactttctgctgagaccgagcaggagctcaactgtcgacgagtcgagaagcttgaagatatgcttgcccaatgtgacattgtcaccattaactgtcctctccacgagtctaccaagggcctcttcaacaaggagatgctctctcacatgaagaagggtgcttggcttgtcaacaccgctcgaggagctatctgtgtcaaggaggatgtcgccgaggctcttgccaacggccagcttcgaggctacggtggtgatgtgtggttccctcagccagcccctgccgaccacccttggagatcgatgcgaaacaagtacggcgccggtaacgctatgaccccacacatatctggtacttccattgacgcccaggcccgatacgccgagggcaccaagaacattctcgaggtcttcttctccggaaagcaggactaccgaccccaggatatcatctgtatcaacggtcactacggtaccaaggcttacggcgacgacaaggagcacgccaagaaatagataatattcattaacatacaaatacagtctacagtcctatatcgattcggtcgcttcgagttactgtaggtcttgtacttgttttgtacaagtacgatactcgtacgcaaatccaatagtctcatacgactaaagtggcctgcagcaagtcaaacactcattaatcagaagaactagaatggcgcgttttcagaagcatttgtaccaacaaaatgaaccacagttttagtacattggagcaaaaaagatttgcaaaaaaagaggacgacaggactcgaacccgcagcctttggaggacgtcgttctggagaaccgaaatccaatgcgctaccattacgccacgtcctcattgtgatttttatttctgctgaaatctgacagccacattttgacatatgcttatgtgagccgggaaatattattttttacctgaaatgtatatccatagaatttttatagataaaagtcctagaataataaaaaaaaaaaaaaagggtctagtataaacgaaaaccaacgtctgcccatgctaaataaacacgctgacgactctgatgaatgaaactatgaaatatatataaaaaaaccacctcttcgcggtcgctaccctttgaatataaaaaaacaaagaaaaaaataaaatagaggaggaataagaggacatcccaagcactactgtcatacgctcttctgcaaacacccgaatccgagtccgatgtgtgggtttgacattgctgagatgtatttcccttgaacccttgaacaaaaaaaaaacaaaacaaaacaagaaaaacaggccatacacccgtcatataggcgggatcgcagtaagaattgccgctgatatagcatattccaataacaaccttgaaagaacatgttttgagggcgttgtcttgcacatttgactaatcaactcgatacagtgccgtgaaatttcgaattgtaccatactgacagtaccaaaattgtgatgcaagtttgtacgagaacgagtactgtagctgtagcatggtttataccacgagttgctggacccactgtgattactaaaacatagccaaccattcatatccacatgatacagcagcagttagcagcagttggaactcatgcgcaccgtcttgaatatgagcacggctgagttgaacaatcaaggtgagagggtggtaaataagtataagaggaattccagaggtagctgccaaatctatatacctctaaggtatctgccaccacctttgcaacctgacagctcgccacgagagaaaaatttcgcaagctaccactccctacccttgcccagctcattactgattaggttcgtccagcaggtaaaaaaatcttgtgataacgttacgtgattagagacgacacgactacaagtagacgcaaaggattcctctaggagctgacggaaacgatagacgaacattcacccagcaacttgttaaacaccgcgtcgaccacctcacattcaaaatgaaagaccagcgagtccaggtgcctgcatcgccctcgcagtcccaagcaaacgcgttttcggctctctttgcaccttctgacaagaactccctctccagctttgcctacaacccttcgaaaccggcatccaatggacagagaccctcggcagcaactcccgcagccttcactgaagagcagaagcagcgcctgcaacgactgaagcccatgttcaaccagctgcccctcgtcaagctgagagaagcagttgctaacagcaccgatttcgaccgagctgtggcataccttcgacgacagggtagcattccatcttcttctataaactccgcgccaacccatcgaaagcctgcttcactggtcaatccgttggctttcctcaacccttctgtcaccaccaagcctgcccctctgtcaaccaaacgggaggtttccaagtccaagagtatcagagagaaatggaaaaaggaggagcctaaagctgaggacgatctcgttgtcatggaagacaagcctagtgcacccaagagaaggctggtgcaggcaaaagaccgagcaggatatacccctcagcccacacggtctcccactccattgtctcctgtgtccatttctcgagacactcccatggatatcgatgaagcagaggccgacgaatctgacgacttctctgagaaggaagatgtcgaccctggcttcgatctcagagtgttggagttcctcaacacctcttctcagagagacctcatcgacctgtcgtcgtgttcccagaaggtcggtgagctcatggtcaagaaccgaccctacaagaacctgctgcaggcccaaaacgttgagttttctgactcggaatcctcatctactgagaagaagcggggacgaggaggccgaaagcgaaacgccggagaacgtattgttgatgccgtctccgctactcttcgaggctacgaggcggtggactcgttgatccagaagtgtgacgtcttgggtaaccaggtggctgccgatatcaaatcttggggtgtggatatttttggagctaaggacggagagggtgttgacattacagacatagacgaggacgttgtcaagaagtcgacggtcaagttcctcaccgagaagccctctattctcagtgacgatcttgttctgaaggactaccagcaggttggaatcaactggctgtatctgctctacaagaaacggctatcttgcattctggccgatgagatgggtctcggaaagacctgccaggtcatctctttcatggctctgctgaaggagcaaggagaacacgagggtccccatcttgtcgtggtgccttcttcgacactggaaaactggctgcgagagttccagaaattcgcaccctctctagttgtcgagccttactatggctcccagaacgaacgcgccgagatgcgagagactctgtccgaccccgagaataaatacgacgtcattgtgaccacctacaacctggcttgtggcaccaaattcgatgtgtccttcctaaagtccatcaaatttaattgctgtgtttacgatgagggccatatgctgaagaactctcagactgaccgatacaacaagctaatgcgactcaaggccaatttccgacttttgctgacaggtactcctctgcagaataacctccgggagcttgtgtctctgcttgcatttatcattccgtctctatttgatggttgtaaggacgatttggcagagatattcaagcacaaggccaccactaatgacgcctcttcacacatgcctctcttgtcacagcagcgagttaaccgtgcaaagacaatgatgactccattcattctgcgacgaaagaaggagcaggtgctgaagcatctgcctcccaagactcacgaagtcgcatactgccatctttctcctgatcaacaggccatttacgacgagcagatggagcgaatgagacagatgcgacgagacagagctgctggcaagccttcctctcgagttggaaaccccctcatgcttctacgtaaggcggctcttcatcatctgcttttccgacgaaagttcgacgatgacactctcaagagcatgtccaaggagatcatgaaggaggagcggtactacgatgctaaccgagactacatccgagaggatatggaggtcatgagcgactttgagctaaacagattagctctccagttccccagcatcgagaagtatgctctggaagaggagccatggatggacgctgccaaggttaagaagttggccgagatgctgcctatcatgaaggaaaacaatgatagagtcctcattttctcgcagttcacccagtgcttggacattcttgagtctgttcttaacactctgggaattgcatttctccgcctggacggccaaacccccgtcgaggcccggcaagacatgatcgacaagtactatgaggagactgatatcaccgtcttcctgctctctaccaaagctggagggtttggtattaacttggcatgtgctaacactgttatcattttcgatctttcgttcaaccctcatgacgataagcaggccgaggatcgagctcatcgagtcggtcagactcgggacgtccgagtcattagactggtgtgtaagggtactgtggaggagaagattcttgagctcaacaataccaagctggctctggacaaaagtgtgtctggtgagggtggtgaagaggaggccaagaagaacgagtccaagatcgaggagatgctgatggcggatgacgagtagctatgtaacggacgataaataaacgcataagatctgaacttagaaacattaatagattatttacacttttttgggtacttttactcgcgcgagtattgggatgtatgtactgtacttgtaggtaagaccttcaaaagaaacacatcatgactttgcaggacgagataccagctacccaaggaaaaagagagcaagccagaaataaaaagtgatcatgccgaggatcgaactcggagcctccccggtgtgagcgggacgtgataaccattacaccacacgacctttttcacgtgacataataagaatgattgccatgcaattatggataatgaatcaatagaataaaaaaaagaatgaatcattagaataataaaaatcattgcaatgaatcattaggataaaaaaaggattattgtccaaaccttggggaattaaggatgtccatcaaaaaagtggaaagggtgtactcatgagtagtactcccccacaggggctcgaaccctggacatttcggttgcaatgcctttagggttactaaaagccgaacgctctaccaactgagctataggggattttttcatatttggtaattctgggctaccaaatctgaatttcgcaaatcattagctgaatcattagaaaaaaaaaattatagaatcattagaataaaaaaataaatagctgtagtaaatcattagaatatatatatatataaaaagcgccaataacccggcttactaggtatatagctgtaatgaatcattagaataataataataataaaaaaagcagcgcacaccgaaacgatttgtaagtgcatgatttatcgaacgccaattactacacaatacaactggctcgatagtcatgtgcatagtcgtatataacggcaacaggcaacaacgagtttaataaaacagcttgtgtctgtatagacttccaattcaaaattacgctacaagcacgacgcctcaggctcagtcaaacgaactgaggtgccctttattctgccactatgagtggtgtcgcttggcagaatcagcggggaaagaagaccctgttgagcttgactctagtttgacattgtgtagagacatagggggtgtagaataagtgggagcttcggcgccgcagaaggactccagagacgcgtagatcttgtcatggggaagggtgtcgaccacgtgatccagaccatcagtgagctcgtacagcgagacgtccagctaaggacccacagttgtgtagaagatctgctgctgctcggtgtaatcttttaaaaaagacccaggcagacatgaggggacacggtgccaaacaagttagaggcacaaattgatactcgtggcattaattacgtacaagtagatattagatacttctcttatttttagttcatctgagatgctttttttttactttgttgtttagcctacttgtaggtattgaagatcataagtattattgatgtgatatagctagttaattaacaacttacaacccacttctagggacacgacgttccgatagtagcacacaccagaagggtgtgtgcttgctcattcaccagaaaagagattctagatcagtggataaaactatctacaggatggacatctcgtctacgacccagctgattcctctcatcactatgtggtgacatctcatcattatgtgaggaattagccaggtattacccaccgggtattaccttcaacagtaggtgtgggggaatactccagggaaatagacattggttttttttttttattttttttttttattctaatgatcatttcagctactcgaggcccataaacaatgttatacaagcacatcggattcggattcggattcggttgttcaggagagcgcatgacatttttgctcgcgtgttcatgtattctttcctgttccatctcttgaccagttaaatatatcaatcaaattttattttaaaaaagggggttttttattctaatgattcattacagctatatacctagtaagccgggttattggcgttcaataaatcatacacttctgaatctttgcgatgtgcgctgcggggcgctgtcggttggtttgtcgacgcttcgtctagttgatgtcattgtcgtggtctcgtggtagtgaatcatggctaacagatcaagaaatcatatcaatcgtttcatgtcttatccagactcgaggttggtttagtttgttctcataatatatcgtagacggtgtaattcggatagggatcatgaatatgattcgtgtgtgtcctgtttgagtctttgcgccatcggggagttgaagttggggtagcacggtgtttgagttgtttttttttctttttttttttccataattccattaatctgagacgtcagcgtgtatatttagcgtgagcagacctcacgagtacgtcatgtgtaccagccatcgtaataatgctcctagagtagaaaacaacttcggcgctcattcctctccgcgcttccgcctcatagccacgaccaccatgtcgcgataattactaagccgaacttacatagtagagtctagaattttcgaattttcgaaatattctcccggtggccaagctggtttaaggcgcgagactgtaatggtattaaaaatttgtaatcttgagatcgggcgttcgactcgcccccgggagaggatattgttttgtcacagcttttttgtttctttattcttatgtaagatcgtggtgcaaaaagattaggagagttgagctgtaggggaattgaacccctggcacctgctaacaatcgaatggaaggcagatatgttaccactacaccaacagcccagaattaatttaaatattgttagaacccagggcctcaggacttgggctcccaaccagtacttactggagaagctcggtagttagtagtcgaagtgtcagaacaattgttggtgcattataatataggaaatagggcaagttatataatctcaggatcggcgtccgcaacttccggaactcctccagttccggacgggcagtgctctccaagcggcgtagtgcgtaggttatccgctagatcatattggaccaatattggaccaatatccactaacctttgttaaacggtcaagtacaaaggcagacaaccatggacaagtagaacagagagttcagactattggacactcacaaggaaacaacagtcacacaagagcacgaatagccgcggtgacggatcgagtatcactaacctccagtatcaggtttagccgcggccgattagccgccgaaccctaacaaatatgtaacgactcagaagctagtcataaggtgttacgattagtcatgccattagcataaaaaaaccttagcagtaatgaatcattagtaaaaaaatgccttggcaagtgactggacgatgatgacgttctacggacgtcatgagtgtgtcattatggatgaatatttcggtatcgcttggctaggtcgcgtggatgacgtgctttacagagttagggttgagatacctgtatatatagccactactcgcaagtatgtaagtaagttatgtttatacaacttctggagctcgtacctagggcgttgaggattgacccatcatcgatccgttacagaatgagaagagaaacgatctttactaagatcctgactgcttagtcatcctttgaatcattagaataaaaagagacgattgaaagccactaacccgggttactacaagtaggtatatatagctgtaatttatcattagaattaaaaaaaaaaaaaactaaaaaatggatccgttgaataaatatgattgtccttccttaggaaatgtatttccctatatatatcggacattcccacccacactgactctgtgttgccctataattttcaccccattttttaccaccccctttcttcattttttcccccatctacttcccccaaccaccccgcttttggtcctccccgaaggctcatacccatcgattatgacaccccaaggactattcgcccgtgactcaccagcacctgtcttatgaggtccacactgcctccctgactcttggacttcacatttagtaccggacacatgccaccgccctcccccccaagctaacactttaccacgcctgcctcacattaccagttacacgtctttctgcataccccgtcgtacgtctacatgtctacatcactacaacgtcttcacccaccaaatggtcatccgacaccgtcttcacgtccaccacgactttattttcaccggtctttcccgtaccctgactactcgtagctctgataaccagtcgcactgaccatttaccccatacccccgaacaagtcacccgggccctcgtcgaaaagatcaagcgtcatacagaccatgcaatcaattatgttataaaaaaggcttattaaggtcagaagtcgagttaaaccgtactgtagggcacaggcagtgccttgcttttattgcaagaatcaagctctgtggtagtgtagatactactgtagtaattggagtcagccaaagatgtcagaatcccctcgattgaatcaaaccatcttaaaaggaggagtgcgctcaaatttcaacactttatccattgagcgtgcttctagcaccagtgctaaagctttgggaaacgttgatcttcccacgttgtttatcagtgagcttgtatcgagtagggtcagttgtgttccatcgtagaatgacggtacatactgtagtcagttctctgtagatatttgtgccgtaaggttaagggcactacaactatgtattctacagcactcaaactatagattgcaactacttgtatatacccttagctaggtcccatagaagtacatacgtgatcaggcgtaagtggtgcaccattaagcgagactatataccacacacccttgtgatgaagatatggaaatggaaagaagttacaataaattaaattgcctcccgtttacgtttacttttttatattccagggaaatacattttaggtacagtatgtacttgtatcttgtatctcttacggtacatatgactgtagttaaagattataaacaatgataaatccgcaaatctgatgactaggtttcaggtttccagacgagcatagggcaatacttcttgcggtatttctctggttcagttgtttttgtttttgtttttgtttttgtttttgtttttgtttttgtttttgtttttgtttttgtttttgtttttgtttttgtttttgtttttgtttttgtttttgtttttgtttttttttttaattttttttattctaatgattctgattatataagcaaatgctacaatactgtctctacaatatagctcacaaaaaaaaactctgaggacgtggcgtaatggtagcgcattggatttcggttcttcagaacgacgtcctccaaaggctgcgggttcgagtcctgtcgtcctctcttttttgtccccctgccccactgggttccattttgtgtctttattgccttctcatccattgtgatggttagttacagtatgtacacggtatactgcaaataccgttactctttgtttcgtggctacccggttccatacggtaacgtcttttaagtaggctatcctttataatacattaaatacacacaagcaatgcactcagcattactcttctaccttggccttggtcttctttttcttcttaagagccttgagagcactaagagagctcttgttgaacatgcctgtatcagtggatacgggagcagcaggctcaggggcaggttcaatctgcttgacctcttcagcaggctcagctccagcctccttctgattgttcatgattctcttcagtttctcgctgtcatcttcttcgtaaccctccagcaatggcttgctcttcttagctcgaccttcgagctcatccacgtactcctgaggcaacagccgcttaatagcctcggcggcattctcttccagtcgtcgctgttcacgtgcctgagccaaaggatcgggatcctgtgtcgcccatcgtacgttaagaacctctccactatccagactctggtgagccatggcctccttagcaaactgcgcattcacttctgtggcgtatgtcacaaatgcaacgcccttgtcatgcaaaactcgaatgcggtcaacgtctccccattcagaaaagtgtctcgagacaatctcatccagagcacctgctttggcagcatcactcacatggatacgacctacatatagagttcggttgactctactgatcgaaccaataccccccatatcatctctgtagtcaaagaaccggtcccgaccaaaacaatcagtcgtaggactaaacatgtcggtcaacacaggaagacgatgcagaaactcacacttgtgcccttgagtacacagaccccgggcaaaatacaggcaaaagtaggatcccggtaccttgtctgcccgggtgtatcctgagtcacgggctatgctacatcgtccatctgctttcttctggttgaacttttcatcctccttgtctcctccactccacttgttgaaccagatattatagacggttcctgtctgtggaggtctgtcatcagtgttgaccgagtcggggtccacctggatccgtgctttccgagtatggtataatgcaggatctttggttctcttcttcttagatttcgttttgaccacctgagcttctgtgggtgcttctgtttgtactacctcgacaccttggttctgtacgctttctgcgacgtctggtgtaaccactggcgaggtttcgatagattccggagcctcagacatggtgggtatttgttgtggcgggcgggcggtagtggtgcaagtggtgatgattgccggaggagcatatttagaagtgtaatatattctgaggctattttgctttgagtttgttgtggaagcgtaccattttacttgatggaaaaattagtgagaaccgcggtgatcggtggaggagtcatgaagtcaagtggatcctagcaagagttgttttccagccgaaatttacaggtaacagcagttataaacatctatggtcgcctcttgtacagttatccatatttgtcccattatccagcacacgattccagacgcatcaattagtttggacttaaacacatcccaatatgcacaccttggatgaacatcgccaccatcgcgtctaacttctcatcacatctcacccaaacataacaccatgaaagaagaccagccgataggttcgggatatctgtcccgcgacgtcagtgtgatcagcgagctggtacgcacactgtctacgcgtcttactaaccagcatgagtcgtcggaaaagctcgaggaaactgcagcttcaattctcgagattgaagagaagcagctgcaggaactgctggtggagctgggacgtgatgagtcggagtttaaaagcgagagcgacgagccggataccacactgcccatgtcggtgctaatagcccgagaaaacgtggagctcgaacaacaattacaacgcctccagtttgttgggggcaagtcacaagagctgctcaagcagtatatgcgggcaatggaggagattgtgggagactcgcagatctatgccgccgacatggaccatgctgcaagccagattaaaaagtcatacaaggagcatgagtgccaggctgaatcacgaaaacaagaattgctggaggagagcaaagagctgaaacagaaacttctacaggtgaggaagctagtgagtaaagcacagataggcttccatgaagacgactgatactaacagtgtgtgcacacttttgcatgggggtaccaattgtcagaatatatggaagaacagcgacttgggacgcgtttggtgagatggaagcatgtattgcattaatgtacttacggaagacagaagttcgggagccctaacgacatacacgtcgtgtttgtttatttgtagcatacatggagctaccaaaacctattatactgtatgtcgagatagagcgtctcatccttcatgacggatgacggaagctagacacatactagacactggacaataaagacaaataagatggtcatgtagtcactaagatcatgctttggagtagtccccacacggctaattgaagaattaagtcattcctgagggaacaacagatggggtttttcaaagatttcgatctcaaattgtcatatgtgacctccgaaattaaaacccgggtttcttggtctagttggtcatggcatctgcttaacacgcagaacgtcggcagttcgatcctgccagaaatcatttttgcaactccaatgagctaggagtttctgctctcaggcattttgcaatgtgctgtgttgcgtggtgagtcttacaccgacactttttgcaaaaatttagaatattgaaaggagattaaaccagcagagatttattgctgatgtatgtgtatgtatgtgtatgtaatatgctttgaggacattgagaatattcccgactactttcatccccgttatatctacaggaccgtacactagaaataacaacttcaatctactaaaatgctactcagccaatatctcagattattcgtttgttacgctaaagatgggtttcattcattcgttcacactttaaatgtgccctatttcttcacctcaagcaagctatacacatcatttcgtctctggtcccacagaggcatattggtcctgaccttcttcagctgctctaggttgatatcggcaacaataactgcagccgaagagtctatgtcgctggcctcggcaagaacagttccccaggggtcaattatcatggcgtgtccgtagctttctcgcttgccgtcctctgtgtgttttccaaccagcgctggcatcatgacatagcattgggtatcgatagcacgagctcgggcaagaacgtgccagtgggcggcgccagttctgactgtaaacgccgagggaaattgcagaatctgggcgccttgctttctcaacaacaatgccagctcaggaaaccggatatcataacaaatagcaggtccaactgttcccactggggtctcgaacggcttgggaagttcagacccgggctctactgactttgattcctgcagaataggaccgttgggcacctccacgtcgaagagatgcactttttggtatctgttgacaatgtctccgttggaatcaagccacaatagggtgtttctgacccggtcagaagaagaggacagctcatgaactcctactgagacctcaattccagacattccgctctgtttgatttccttttgagcctccctgattgctgcgatcatgggcgaattttcagcatttcgtgcaagactcaacccttccttaggcgagccagaaatgtagtcggaggcttcagggaggaacagagcctgggcgcccagggctgctgctctatggactagtcctgcaacaatagaggcattgtgagtaagtgaattggttgcacaaaattggccgactgctgcgagagtcatgacgggatggtggaatggggaagtgagtggttcgagaaggaagaaagataaagtatgataagagaagatgcatattgggactggtcttgatttgtgatgttactgtagccaacagtacaagtgtgtaggcaagggtcggaatgcgccattcacttcagaggatatccattctagtcaaatattgatgttccagatatattccgtctctgaagttggagcagtttcattacagtccctccaactctaccaattctgtagtgtggcttggtgtaaggccgaattgcagttttctttttttttttagtgaaactggattgaataaaagatgattatggtatgtactgtactctgatgttagatacccttttggttctgtggaactcataccccaattcgattatttgggggggggctgttctgtggaaattcatattctgaacactaattttcacgtcttttgaatcgcacaattagtcagcccaatgtaggtctacttgcaatgctctaaacgaagggccaaagtctaattccacctttgaaaagtccaagttcaatctcactgccgccattcagccacttggacctccagttaccatgcgctggaaccttccactcccgaagtgaggctttatcgggtctacaacaacacaacactgaaaagacagacttgtgggctgcaggttaactataatgttcggacttgacgaggaggagctaaacacgaccgtggagaaggatgttgaagtggtatctacaaggcattttaatcaatatatgaatactgataacaatttttgacgtgaatacctcttttattgccctcaaataagtcttttcagccagaaatcacgttcgacccaatgcccggagtgcatgaatgatcaactttattcccgaacatctaacattcttcttcagctacactctccaaccacacaacaatggatgaagacgttctcgacactccccgagatggaatctacattccctcggctctgctgataatgggaatgggcattctggcctactacttggaaaatcctctgattttcgtcggaggaatcttcatcactctgggcctggctggtctcaagctctaccgaggatcgggctcgactctcttccggggccagaacgatctcaatgatctcgagaaggaggatcccgagttcctcaccgctcactcaaagcttaagctttacgaaatggctgtttccgagaaggtgctgatcaacaatgacacctctatctacaccatcgatctgccctctccccgagacactttgggcatcaagcccggccagcagattggtgttcgaattgagtgggacaccaaggttgctggaggagccggggttgccatcaagcatttttacccgattcagatccgacctggatcttttgacattgtcgttcggcacaaccgaacccctcttaacctgcagtacaaacacaacaacgtgggaggcagtgaggacatggtcggtcgatatcttgatggaatgaaggtcaaccagcacgtcaaggtcattggccccattggcaagccctactacacccacaacatggttaaggagctgctcatggtctgcagagacactggcatccaggccatgctgcccatcatcaacgagattatctacactcccgaggatctcacttggatcaacctgatctgggagactgagactgctgatgccgcttttgtccacgacgatctggctgagattgcccgtgtgtaccctcgaatcaagatccgacatgttatcactggccccggacaagtctctgaagagacccctgcctccacgtacgatggtcgtctgggctactcgtttggctctcccatctctgagaagcatgtcaacgagctacacgactccaagctcgaatacgacgagtccctagtgatcgtttctggaaagaaccctgatgattcccttcatctttccaccgaggcaggcaagaccggccttcgagctattgttgtttaaaatgtaccacgtaatgatatcatatttgaaaaaagagagcctggatctacaagttatacctgtatagtatggatattaccatgtccattttaataaaattcgtttgaacaagagatggccatacatgtaacaagataaaaaaattgaaattgatttttgaaaggttggggtcggctattggggaatttgaagtttcagttataaaaaattggtgccgcactatcgtctggtaatgttttaatatttgtcccctgctggttcttgtgcaatgacaggtggcaattttgagaactactgtgtgttaccagtgccaccattggagtccttgtagctatcgcactgtatcgtactgccaactctgctacagtaattactctgcataaaactgccactgaataagctcttcttcattgggagatataaccttattctttccactcactcgtcgcgaaatgactcaatgagactggatagatcaagtgatgggtctgttatgatgatattttccaggtgtaaagtcgttaagtctatacaactgtgaaaaataaaccacccctggtctcggttcaccccaaacacagaccctaacctttacaaagtgacattttcttaataagcaagcccctaaccctgaaacttgcgaaagtgaaaaaaagttgcctgtagtcaaccatccaccccacccaaaacacacatcaaacaactatgtcctggctattcggaaagaagaaagaggaacagcccaaggttgaggaggtcagggaggtgaccttcgacctggaccctaacgccaactccgccgcctctttcctcaacgctgatctcgacaccacaaagctgcatcccatggctggtctcgatgccggcatggagtacttcactctcgagggcaatgagaccatttactacgatggtctgcttccgtctcgaggatggaacgatgacctgtgttacggaaccggcgttctgtacctctctggtctcggtgtcggaggtttctcgggtctaatggaaggtctgcgaacagtccaggagggcgcaccagccaaaatcaaaatcaaccacgttcttaacacaatcaccaagcgaggtcccttccttggtaactccatgggtgttctgggatttttttacaacatcatcaactccaagattctctacgacatccgaggtaagcacgactccttcaactctattgctgctggagccattgccggagccattttccgtgcccctcgaggaaccaaacctatgctcattgcttctggtatcaccgctgccggagccggtgtttggtgtgtatttaagcaggctgttttcggtcctcctgctgagaagactcctcttgagtaaactcgataagaggtacattgtacatacgcgggcggttgttcgaagagtaaggcgacttccctaaaatatatgagtaacgagataattcgtgtagatatgtgcacatcatttgtagttcaggtatttgagagtccaggtgctgagtattctcaactactcgagacaagtagtacaagcacaagtacaactaatggacacagacaaaagatcaagcaaacagctggtattgtacttgtagtcgactcagaacttttccgaacatcaatacctcacttcagaactacaggtggatccataactctgaagagccccaaaaaggatattgtccaggagagaagacaaatcgaagttatattatatctgagcctattattaagatattatctggtatagtactatatcacccattcaatgtgtccctatactcgtgccgtagggcctggtttgcaattatgatcctcagttttcatgcatgctgcatcatgtggaacattatagaaccaccaaacatgaacctcggaactttgcagtctgaagcgttggcataagtataattccctctaattattgcactttagttcaagaaacaatatatcgtacatacctcgtactcgccctacaaacaaaatttcagtgtcatctactccaaccaatagtgcacgtgcttacttctaaattctccatactgtaattacacatctgccatcaaatacattctcccccatctatagctaacgtcagtgcttcacgatagtaactcgcatcatcgtcatcgaagttcagatgtaatcaggtgaagtttgaaagtaggcatcccggtcatttgaggcatcctggtgttcataacctgagatatcgttgctggtaaagtactcttcgtttgaatgttccttgctacttatagcgtagtcgtcgatgtgctcatcctctcgggttgtagagacttttgtaaatgtaccatcaaagccaccacaaaaccaaacattctgaggacagtagagctgtttcctggtatctcgccagttgtacgagcgaaagaagggtatctggttctggtcaatgtatacttcatatttggcttgtgttgattgtgcctttcgacttgcatcctgttggatatcacagacttgaactagttgcgagctgagcaggcactgatgctcataactaatccacagttgtcttttaagatggtttagttcccagccgtctgttttgttgtgatctttccccaaagctctcattatgaagtcgttcaataccaaaaacagcgttgccaaacaaaccaactgacatgccttgagcaatcctagggaccaagtgtcgtgctgtgatagctccgttgtaatcatctggagagttgtttcagttgttgaatctgtgggtggcctcgtttgtatctgtatcgatgtcatcctaatcaacaggaaaatatacccgcactttgtgtaatcatactgtagcatacattcttatttaaataacactgtctttctataatgcaacaagagcagttcctaatccttaatttttcctgatctaaacagccacccgcttcgcagatgtctgctcctcagcctccagagcatgcttgccagcagccagaggtgtctcttcaaccggtgcctcttgaacggcctcctcaacgttcgaaaccatagattcctccacctcccttgtggccttctcccccacctctttgataacctgctcttcaggctttttggcttcctcctcggccctctccttgagcatttcctcgtactgctcgttaatgtacttctccagactctcgcagtccttcaaagcagccactttcttataactgggactctttccggggatcatgcgagtcagacagtattttgtgttctggtaaaagttgtcatactctcgacagatatcaaggtactccttggtcacctgctgccaagggagcataccttcagctctgaaacaagaagcgttagcctcggctgctcgggcaatcatagctccatcgatgccgtacttttcctgaagatcagcaagctcatgtcgaccttcaacatctccgttaacaaggcaggtgattccgtgcttgtgacacacctcagctaccttggccaaagtatctcgaatcacaggttctcgaggtcgcatgggtgtagttcgacagtggatcgtcaggtttttgactccggtctgagccagcctgtccacaagctccagagtcttctcttccgtctccagcagtcggatcttgactgaaatgctaacattgaaaggctctcccacctccttcaccaaggcctccaggatagcaaccagcttatcgggggtcttgagcagagcggctcccatacctgcatgcatggaaaagtgcttgggacagccacagttgagatcaataccagcgacgtccttggcaaccattttgcaagcggccacggcgatctcggggttagccgaacccacctggaagatgatcttgtctctctcagcctcagaggttcggaaaataatggcctttttctcagtgtttcccttgccctgctgactgacagtaaagtcgaccgtcttggtcttctcgttccactctcgggtgcactccaacatcttcttgtccacaatctcgggactccacaccagatcagccccgtacttgatggagagcagccgcgtggggaactcgccggaacgcaccatgggcgccagtaccaattttccagcgtaactgaccatgttgctaagtcgtagcgttggtctcatggaaagttggaaaatggaaaaaaatggatgttctaggtcatgtgatgcactttttttccctgctatgaaactcaaacccttatctgcagatgggagagagacgagtcataaggttgtaggttcgagttttggaaaaggggtatttatgcacattataacatatggatggtgaccattaaatggtggctaagtgtattagaaaaaaagggtacaaggggttgcatgtatcaatagacagaagcctggtgatgtatatccatcatccatctgcccatttttttacccacaccctgttacagtgtacagtactgtaagtatattcttttttccaattgagttgagtttgtaaggtaatcgctgatgagacgtttgattacctacggcgatgaaagtcaccttttcccaaggttcatgcgagacgcttgagggagacttgtattggcgttattagcgacctctctcttccagacacatcgcctgtgtctcgtatgtgcagggtccatatcgtgcttcgttcagctgttattattttctcccctggttttgtttggaagcttccactttggaccagtagctgcagaacagcgaaactttaacacgaggtgcgatgatcccagaccggaaattagcaggtcgtgttttgaataggggtgtagggcaggtaagaggggtttgcgtggtctgtttagcgggggagccacacttatatatattcaacggatctgacacgcattatgtagtgtgcaacgattagaataggtaggagcgcgctacccaactccgtacctattttagtgtcgactgaggacgctcaaatattatctgaggttactgtctcctcgtaataccgcttactgtacacacatacgacgtacttctccccacagtgtaagacttatcaaagctacagtacgccatctctgttcagcacatggcacttgagtacaccaagccgactcatatttcacacccacaccgacacctcacgcgcttcacacattccgaaaagctccacagacacttcttgaaggacacacgatccacactcacgcgcaatggtggaactgactatcgccgctatcagggatcactaccggaccaaacgggcggccaaacaggactcgttaccgtatcctgttccagcagaatccacgcgcatgcctagcccgaatgcagcacccatgcctcccccaaaaatcgcgccccagccggttccacagacccagatgccgccgtcacacatgaccaacgaccttgagatgacttccccgcgcaagggcagacctgtcgtgggccaaggtatttctatgccgaccatcggagagccgacgcaccaaacaccacaacaacctcctcaaccacaacctatgcgaaacccttcgccaccaaaaatgagaccggtcaaatcccttattccgccgagcccgaaatcgaaacagctaccggatctcccaccgcccaaaccgatatcaaaggatctcagtcttccgatggactcgcccacattcaaaaacttcttctcgtcagaagaaatgttcaaccaagccgtggtccctaggcctctggtccatgatctggttcatgtcattacaggagaaatcaaagctagaggtgagtacgaaaacgagtttttcgcaccaagttcttcatactaacacaggaatcctgacgccgtatctactgcttcccttcagacccgattcagatccagacgcagtacctgccctggttaaccacatctttcccaaaaatttccagcctctgcagggagaagagctgttgagaacagtcagaaacgcggatatctatactctctgtggagtgctcaaatggtgctggtgtcgaatgcctggaggagtcgtatcttggcctgtatacaacacatttgtgcaggcagagaaagatggtgaaatggaccatgacgcatttctcactctgattccacgctgtatctcgactgaagcccatgcttccattctctacgactttatggatcttctggcagctattgccactcatggaaaaaagaacgggatgggaggtcgcaagctggcccgcttggcgggatcatgggcattcgatgtgaacaccggtgcggatggtcctgtgtcgttccaagatggtcttgatgcatggagtagagcagctgaagctacgaaccatctgttcttctcgtttttgagaacaatgcttccaaccaaggagagtcggattgaagcgaaccggatccctcgttctctagaggctttgctagtctcctcagtctaccctcctcttcctctacataaatctcgactagttcctgttcctctggtgaccttgacagtcggtaagctgtcgtcttcgccgttggtacttcttaagcgagctgccaagactgtgagatttgacaatcctgctgttttcgctaccgaggatgatttcaacactcttttcttcttgttcaaggaccccaagattgtggaccagaagttgtcaccagagtccaaacgagtgttacacgatattgtgcaggagaacccactcaacaacgaagtgtactacgacactcgagctgctgagtggaaggtgcgcagttccaagctgccagccggccagcatggagattacagagccaagacgtggtccaagcattacaactcgacatttacagatccagcaaccggtgcacgatcttccaacccccacaattacgtctatgacgcagatgagggctactcttacaagatgagatcaaaccaaaatgtttctacctgggaggagttcaagcagtctggatttgaggctaacgacgtcattcggcggccctccacagccctttctggccgttccattcccatgaacatcccatgggctagcacgttgcctggccagaatggagatacggcgcctgctgtcaagtccggttatgagcagaaggtcaccgctgctgtttcccaggttgctattgacgatttcttcgtctgggtgtggatgtcttccctgtccattgagcagcccgagatgaacaaggctctctttggacggtctctggttgttgaagtcgagattgctcctggtcctggggggagacgatgggttgtggtggaggagatcctatatcctcctccaatcacacctgttcctgaacccaaggccccagagcccaagccatgtcctgtgcccaagcgaatcgtttccacaccagttcctcctgttgccccttccccgcccaagaagaagcatacacgccgtaagtccgaaaaagtaattacttttgagtacgacgatttggaccctcttgtggcagctgtggctgatcgaattgagcgtcgtaactctcagaggcgagtgagtttaccaccgccacctccccctccaaaaatggctgactcgtctactcagacttactgcgatcagcaaactcagactgatcctgttgagcttccggatgagtacatcattgagaccacacccgagccccaatccaagccccacgagaccagcagggatcttggtgttcagaccatgagcactcagagcaccaggaacagtactaccaacatgatcacgagggatacggatatgggccctgctttcagtgtagctgcttctacttttgcgccgcacgaggagaaacgtcctgactcaaagtcgtcttaccacacccctgatcacggaactccgatgatgggtcatcttagctctccttcctcggcttctcgttccgctacacctgaagcgtgggtccctgactcccctccttcgttgagtcagctgcacatcaatcctctagcatccgagcaaaagcatcagcccctacagcctgtcgtgtccatgatcattgattcgtctcccgagcgaacaccggtcgagattccgcagggtccccgaactcccaaactggtgaagagaaagcccgttggatcagctcctgttcttccagctgtcacagatgtgcccgacgagaaacctcttccgactattgtttctgacattacccctggagagcgaccaggttcaatcggttcaggattctccaatagcagtattgaccaggatctccaccgctcacatcagcctctggaagaacctcgaggtcttcggaccttcccctcggatatcaacactccagaggactcggaatggggtgatcgtggggagtctaacgtcatgcgaggcccctacaacactgcaccttatcagatgcctgatcgaccggtaggtgcacctattcctggttcaggagccgcaacaacccataatgtccctgaagcccctgcacctccacatgaggatgtcgatgagactgggcctgtgagagtcagaggcccaataactgtggctgcgacggccgctgcggctactgctgcggctagagctgctgctggagggcctcccggagccccagagactccaatctcaatggcgcactcgaacatcccttccgtggctccttcagtagccacagcttcggacacggaggcctacagaacggcttccacgacagatgcctctcccgtgtacgagcgagattctcgaataatcccctctgacatttccaataacggtctacaaatatccggtatcaagaaccaaaagatcctgccaagaaccgtgtcccctggggtttactcttcggatcagagctgctatgagtatggctatgattacacagatgacagcgagtacgaacatcttcctgaaagaggtccccaaggagtaagaggtggaagagtggtgcgcggaggtcgtggaggtcggggtggccggggtggccggggtggccggggtggaggcattggacatcttcctggtggtcctatgggacctatgggacctatgggccaaatgggacctatgggccaaatgggacctatgggacctatgggacctatgggaactatgcaacgatcctattcgccgcaaggcttccctggtcagtacggttatccttatggatactggcctggaatgatgggaccccaaggcatgggtatgatgggacctcagaatatgggtgcgggcatgggtccacagggtattggaacgggaatgattggcccccaaggaagcatcggtatgatgggccctcaatatatgggtccaatgaacccgagcccagcttcttccaagtcttcccagtctcttccttcggtagattctgcgtttatggaccgaggacctatgggcatgtccagcagtggggcattgaaaaacgttaataagagacacacgcccaagcgggatcttcagtcgcctgcttccttttcttccggctcatcctttggtcccatcgccggtcgttcggctggccctggtggtcctcaaaatatggcccctcaaggaatgggcaatatgggcatgggcatgaacaacgtgggtatgggaatgggcatgggaaacatggcgatgggtatgggaaacatggcgatgatgaggcaagggattagtcctcagcaaatggccatgatggttccaagcatgggtggtggtccaggcgtaggtcaaggacctatggggcctgggactgtcatgtctgattcggattcggatgccagctattaccctgggggacctcctcggtatctgcacaaacttggacgtggtgttgaagcccctcccgatcgaaaaggtagccattccgagaacagacctccttacggctacccaatagcgctcgataagggcaagggcaaggaggagtctcccgatgcggataatccacgtagttttgactcacgcccagtaggtcatgaacaccaacaagacgaatctgaggtggcagacacagcctccgtggtagattcgttcgtaggttcgaatgtggctacggtgattgctacagaagagccttctacaaacagcccacatcaatctgagttgactctcaagttggaacaaactccagtagcgaagcaggctcacccttatgcagcgtcacagacatatcacgtgcccactcagcaccattccctcagtgcacaggctgcccctgaatctcctcccgacacacctacttctgggcctaccatccacgatatccgaaagtcgtggtcttcggagaatgggcagcgtcaggcggttcctcctttgccagcagtggtcacagaagacgatattaattccgacaccaacgttcagacgtctttgagtacagctatgggtgttgacgactatgtgtctgcttctgttcatctcaacagaaacccctcggtgatcacaggtgcccatgtttcctctgtagctgttcctcttgatgattctcctgctgctaacaatgtggatcaggagaaacctaggtcgcgcggtgcgattgaacccaactcataccgagtgtctgctcctcctgcaccccgagattccggcactgctgttcaatttccgaggcacggacgctcagtatcaacctcgcaactcaataaggcccttccgcctcctcccattgatgtgaatgccgccaactccggtttctcggagtctacgtcatctctgggctcggttaccacgccgaccagtggcggttctccgactaaacggtcgtctttgtttttccgcaaaaacggaccgccttcggatgagcagctaagagagttacgggagcaggaaactctgtctaaggagcacattgtcagctgggtggatcgtcgtaggccagatggcaagcgggtcttttccgccggcccgtatgacgccgtttaacactgttcgacatttgatttatttgtgtaatatattcacttgctatacaattataggctgggattcttgtacttgtagattacacgttctcgtacgagtacttatgcttggggtggctgcgtgcgcttggcttcatcgtgtctcctgatcccaatagtacgagtacgagtacaagtcaagctcggtggaaaactagggtcgctattacggctggtgttagtatatgggctttaatggaggctgtgtggacatagtgtatgccaatatacttgttgatggagtattccatgccagatatataaggaacgcctactgtacatctctcactccgatcgtacatctttcgtgacagatccacatatgaaacaagaatgactgtcaggggtacagcaggggtcgccaccagggaaacccggatataaccgtattttccccatccatattccagagcctccctgcctcctgcttgccccctcagaccctataaagacaaacacaacccgaaactaccgcaaagtgtaacgcagtttgctgcgtgaccgttgtagacggctaattctaaccgcgattgtctttctcaactaattcggtaaagtggagcatcgccaaaagggaggcaagttgctcggctgcaaatgtaaagaccaagacccatggtatatctcgtatacgaagcccaatgttacggccgcaattggctgctatccctgtttgggttcccaccggaggttttaatcgtgcatttccgttggcccgcttgcgtcaacatgcaatgccaagcaagcattttttgcaatgtccgacccggatgtccgacgcacatactgtacaagtaatgagacgttgtagctagaacaagagaacatacggaattcgggccgactgatacccgagagttgcccaccaatggagaccgttgaaaacgagtacatatggcatgtatcaggagaccactgtttgtcacaaagactgggttcgcaggctgtgttctagaagaagtagacaaccgtggacgagactgactatagtcgagtcatctacagcatctacttttgtttatattgataattaataatgtacatctctaataaatagccgctgtgtgaattgtttctttgtcgagtagcggggggggggggggaatcacgaaccgtgatattttgtgggaccgttagtattgttggggctgtgtctgtcaacagcttcattttcgccattttagtttcttgctgactcgtctccaggaagactccgtggggctctcacaaggaggctggccgttggtgacaccgtgtttgttgggggtgatgtcgatggcggttgcgaactgggtagaagatacaatagccatggcaggagaacagctggtagaacagctggttgtggccttctcggtgtgcagcatcgagacttcaaacaaagagggtgactctggtggtgtgacgggactctgctgtgtaggagaagaggaccctgaagaggcaggcgacgtgagtctgtgcttgaccactgttctgaggggcggtctgagccgttcaggagcagaagccggcatgcttgagagccgttcattggacgagttgttgcccggatggcagcaacacatgtcctcgtttgccacctgtgtgatgaatgggtagtatccattttccttcatgagttccttgacctgaacaaccgcctccttcagggtattggggttgggggctgggtttgtaggtagctcgcacaatgcgtctcgcaactcgtaggggatgttgagctctcggggtgagtctcgctccatgtatgacaacatcattcgttgccatagaatgcacagataatggtcctccgggttttcttcgtacatgctagcgtacttctgggcgtccgtgatgaactccaaggtctccaggcagtgtttggacgagagatatgcagagaaggccgacagcgagtatggtggctgggcgttgttgttgagaatatcgtccagcgatggagacgagtcgtttgtgtaactggaacctcctgacgcggatgatgaagacggcgatttcacgcacggcttgaggcgtgggccgtagtccaggtagtcgagcgaagacgcccactccttgtcttcttcgagcgggtccatctgtcggttgtgtgtcgagaatgagtcggtttgtgtatcaacagcaatatcgtcgtgctcgtgtgaaaggttgttatataaccagtcgagtacaaatggttgtgggaagccccgtgtttgatatttgagcgtcgttcagttctggtggcaaagtggcgaaagtcgtgtgttgtgcttgctcgcttttttgcgtcctcgtgtgcaaattccccgtgtggtcgtttcacaatatcgtgactcgtggcgttgcaaactgtagttaaatttattgggagggttagtatgcagtgggtgcttattacgcggtggctggtggtacagttgtacgtaaatggaaactgctttgttagcgcagattatgttacgcgaacttttaggtcggcagtgttggttcagagggtgtgtggatcggttgaacagctgactgcaacaagtatctctgtgctattcaaataccacagtcgtaagttggtgagagagttgggattcctgatgatgggcaaaaattctcgagtgtccgccagttaagttatacgcacatacatgccggccgagtgactgcttatatgaataaccatgctgagcctcttttacctttttgcacaatggccacagtagtgctttttctcgtctcgtttttgtgctaactgtcttgttttcccttttggggcttagtgcgcgcttctcacatgtacttgcatacgtgcaccaaagaatgaatggacattagaatatagagttagcctgtctttgaggaactttagagacaagagagaagggaaaaaatagtagacttcgacccacaattacgtcgggtaccattgtcttatgttgcggtttttccttggatcatttgtctttctcggaacgtggccctccctctaatgacgacaggctgcaccgctgcccgcagcaagcgcggccgttatgcaactgtaccctgtccatttcgaagatttcaaattgtacaatttcccgtgactgcgtgtgcagtgactccctaaagctctatgctgtaccgggtaactagagcggctgacccctattgcaactttcttttccctgtcttctgtaaaccttaatctcacaggtttgggttttggcgatccggggggttcacaaaagccgttgttgagtgcaagtctttggtctactgcaacttgcccagcaaaacccttggcgagatgagataagtgttcagggcatcaatcaacatgccatatttatttttggtagtatgacattcaagtcgctacacatgcgcctggttttctttgtaccttacccttcctactgtacatacttgtacgtggcgtttcttcatacggaaggacacatgatttgcgacaggggtggttgggcacaacccggtcgcttcattggggactgcaccagagccaccacgtagccagagcaagtacgcaaagtgcggacgacttctgagtgatttataatatagtggatatcgcacagttctcggaagaaatcaatcacttgcaccaaaacggtgcgtcgctacctcaaactatcgacattcttccgtgcagtttttacgcaatcactcaaatgtgagacatgaatagaagcaaccggattacaggtccttttctttaagtgtaggtcgttctttgcagttcccagctgctcccaactacagttggagacaccacacctacaagtaggtacagcatgacccttattagttaaattagccggttaatgttataataacagggtgacatgtctgtgagggagcttgtggttcattgtcggtacgagatgtaatgtgttggtttctaaagaatcgaacggtttcgggttataaataacacaagattaaatcgaagtgggcaggtggaggcaggcttgctacgctgaaagccgttagtttgttgctccatccgtaccatttgttctatgcgtccagtatgcagtatatgcgagtttctgcagaaaggtacggctacatactgaagaaagcagtggcgccacttagtgtggcaagagctttgcacaatacaagaatttaatcaaattgtattgtgtcagtctgttgtgcgagttagagtcgcatgtccatagtgagttaacttgcccactagcaaaaaatgccagtcagatatttttacacaaaaggtcattctgcaggccttcgtaatacaacaaaaaaaaaaaaaaaaaataaggtgcatttaaaatcacagtggccctaaaaccctcgagacccgtcttgaatgtaagaatctttggacactgtcacagtgccagatcagaattcaacgtcagctgagtcaaggaattgacgtatgacatgccattgccggtgtcagacagacaatagaacaataacccttgggttcatttcgcacgcctcgtgcaggtctgcttcttgttatcattgcacgcccggcacatttacggaagcagaagccctttgctttttgaaggactggaagaatgtgcatagaatcttcatgtcaatatggggtgacattgtgctgctggttattttcgaacccaacctcatggcatgcccaggcgcgacgctcgttcccagaccccaactcacattttctggaccatactaaaagcagagtatgtactgcactgtagttcatttttcccattcagtttcctgttctgactttatcccagtgattttatctcattgttgcaacataatggcttgtttgtcttcaatttgaaaacacctccatgaaatgtgaccagttgacaccagcactccgtgtttattgacggtcgcatctgacattattattgcctgacccaacgaaaatattgaactggctcaggctatttataaatgtgtcatgttggaaaggtggggagatgtctccgtctgggtctgtcaagtagatagtctctaacaagtgaatgatccagcagttaggggttggatttcaactatttgtgctatgctctatacacagcctgtaagcgcgcattggccactttattagagcaagatggtcttatcgaagcctttgcttctcccctgattcactaatggtttgtgttttttttattattcataagattcatacggctatatacctacttgtagtaagccgggttattggcgttcaataaatcatacacttctgaatcattgcggtgtgcgctgcgaggcgcatgtcagttggtttgtagacttcgtctagttcttgtccttgtcgtgatctcgtggtagtgagtcatggctaacagatcaagtaatcatatcaatcgttccatgtcttatccagactcgaggttggtttagtttgttctcataaagatcgtaggtgtaattcggatagggatcgtgaatacgactcgtgtgtatcgtgattgagtcgttgcgacatcggggagttgaagtaggagtagctcggtgtatggatgttatgttgttggtgttggtttttatatatatatttaatatttcatgttttttttattctaatgattcaggggccgtcatgcacttataggccccaaaaggtttcaacaagatttcggaataactttcaggtcccttggcccagttggttaaggcgtcgtgctaataagaaattagcctctttgcaacgcgaagatcagcagttcgatcctgctagggaccattatttttgaagctgctgaaaactccaacgaaacatcacgtgctcaagttatactacatttacttttttgcttccgctattttgtgtatcatgactgtgcttactcaaccccctctctctctgttatgagaaatggatatgacatgtaactatcgctcgactgaaagtacacccccaagcagttcaaataatctagtggattcacgtaactaacttatttcttagaatgttccttgtcatcaccgtaagccttggtaccgtagttaccgttgatacagatgatgtcctggggtcgatagccctgctttccggagaagaagacctcgaaaatgttcttggtacctttggcgtatcgggcctgggcatcaatagaagtaccagagatatgaggggtcatggcgtttcctccaccgtacttgtttcgcattattctcgggctgagggaaccagacatcgcccacgtagcctcgaatctttccggactcgagagcctcaacaatgtcctcggtgacacagatagctcctcgagcggtgttgacgagccaggcaccatccttcatgtgggaaatgagcttcttgttggagaggcccttggtggaggcgtgcagaggacagttgatggtgacaacgtcacagggagagagcatcttctcgagagactccactcgtcgacagccaatctccttctcgacatcagcgggcatgggctggtagtcgtagtagagcatctccatggggtcgaagggcttgcatcgcttgagtactcgctgaccaattcgtccctccaactgtaccaatgaccttaccctcaaggtcgtaagagtccttggcgacagcggcaacgtcccagccaccagaaatgatctgctcatgagcagggacgaagtttctgaccagaacaagcatggtcatgacaacatgctcagcgaccgactgaacgttggagccagtgacttcaaggacagcaatgtctcgggcgttggcggcatctagatcgacatggtcggaaccaacaccggcagtgatacagatcttgagcttcttggccttgtcaattcgctctcgagtaatgtaaccggggtggaagggagtggtgatgacgacatcggcgtcgacaatttccatgtcgaggacagaatcatcgccatccttggaagaggtggttaccagagtatggccctgggactcgagcaatgatcggataccgagctcgttctcggtgcatccgaggagtttgggctcatcagccgcgtgggagaataagaaggaccatcgtagtgtttgttcgtgtgcgtgtaagtgtgtgtgatgaaatagaaaagtcgaggagaagaataattagtttataggtccaattgaggtatatacccactgaatcgccgcagtaggggatccgagatccgttcatggaggtagtgctgcatgcatgtggaggtttgcaagagccaggtatacacagttgatgagagatttaaaatcacagacttcaagtggtacattactcctggaaataatgttctgtatttcaaatgtagtgtaatggtatctctttcagcgatatcaccatcttcagagtcgtcgatcagcggtcgtactcaacggtcccaacctaattccggataagtcgtatgtagcattattgagccgcagtgcaacggagagtattgtttgcagaaagaaaaaaaagtgtgtggacacctccgccttctacaagtagtgtatgagggcgggggttgaacccgaagcctcatacttcggatggaaggtggatcttacggtaaaacaccagatatatgaaataagactcgcgccgatatgcttatcgtagatggtggagtgttttgagagtatatacggctttcggaaagagagctggttgtcactctgctcttacccagctgggtgaggacgtcgtctaatatcctcctcctgctcttcctattagacgcccagtctgatgggttatgcacccccaatatggatgaggtagaaatagccgttgatcaacaggcggggtaatgggcctggtgagtggttagatgtggctacttgtagaaaggggttttggtgttaaacagataaatcggttggttctgattgataccgattggtgccgattatttccctcttttgtgcaatgtggaggctcacaggttttgtctcaaccccagcagcggtggagcgtggatttgagctacttgtatatggccccaaattaacagccatagcgacagttattctgcacctgaggacatttttaagcgcaaatgagtgacagccattcagcagctcagtaaaaatacttgttcttgtacatcatgtttatatcccaccaagtaatctacattgtacaagcgccgccattatggcccattatcacccccccccatgaccccccacgtaagtctctgtgcacagcacgttgccaagacttcttcggttaaattaatattacttgtactgttcaatggtgggttgttgaataattatcgtgactggcagctccgtcgagctcatctcctattgcagttgaagactcacagagtgtatggttacaacttgaaccatgtcgcctgaccagtttaagccgtgatgagcaatctgtgacgtcacctggaacgagggtatgggcatgcactggtagcaacacgtgtatgtatcgtaccagtacatcccgtacaagtacatactatacatacatacatacacatgtcagtcacacccacagttgctacgtatttgtagtacacccttcacccaacattcggctataccaaattcggcagtggaacgcaaaggcggtcacgcgaaaggccacgcaagaccacgcacccaacacgatactccacacagtcaatgcaccatatgcagggacatcggactttgctattttgggagccgattgcgacttgtttgggaagtgggagaccagtggaaggtgcaaactctaaggtctggatctctcgaaaatcagctgagctgggtaaaaaacgagggtttttccgatgcatcaaagggccgctgcgatagtcgcgattttcacgatcggctgtgttgtgaatgttaatgttcccccaacagaaggagcacatcagagctggggtaatgtagagcacggaacaagagcgatgtatcgtatgtacagtggacagtaccaacatgtgcctgattgtcgtgtcggcgcgtccgattttgacacatgctggtacggtgtaaggtgtaattaatctacaatagcaacggtattattgaaaatatagagatgaaattatcgtgctattgctgttatgttcggttttcaagtggtcaattgccgggtaagagaacaagccacgaacagaagatgggatcgtgtgcgcttaaccacgctcgtgcttctaaccgacgactcccaaaagtggggttataatgtcggaatcagaaatacggctcataccttgggggcattcttccaatccgttccgaacctttccgacctttcccgagctggggcgatacccacggttgtagcaaaaaagggaggaatattcttgacgttgttgcaggggaaatgagagttctacgcatgtgattgtaaagtgggatgggggtggggggaataatggataaaagaaggtgttttgaggttcaattgaattccaattgcatcatcaactgtctaggaccatccaaccgctcggaaatccctcaaacaccacattacaccttctccagcgctcttccccgctgaagtcatctcaaaaatgcacgtcccaacgccatgtaaggacatgtactaatatgtaataaagtttggatgcatgtcgggtctgcgcttcgtgtgctgtgttgcctgaatgagctggagggttaggaaacttggtgagaggctcagatgcggggaatcgggatggctttacaactggggtgcagccgttaggccggaaggagggggactggcggagataaggagttttcgagttggggggatcaatggacagcttcgctatctcccatctgcgaaagtgccccgcatttcacccttgtcttatgagtccctgacactgtcatgatttctttctcccaccagtgtcgtgggtctaggggctgtcattttatttttccgccacgcttcttaccttagcctcggcatgcaagagactgacaggctttatgtatcatgtatgtatcacggatttttgagctatgttcacaattgttcggagtctaaagttggtagcaactaggctctaaataggatgaattgtctcgaccgatttatatataaaagagacgcatccgcccccacggatccgctgaagctctccaccatctagtcatctcacgacatttgactaacgactctatttattaacctgacggtgcaccccaacccagtaacacgttactaactaccccgtctctatcaccacgtgactctgaaccaaatctttggctttattttcacgttcccaacacaaaatccaaaccgccaatcaccccatctttttaatcagcaactctcccctcaacactacggttttcgaagtagttatttattcatatttataagtgagtatgaattgaacgcattgactgctgaagtgacctgccaaatcgacgatattacgcaccagccaagccaccaacttcacaaccagtgagcgccttgtggaaacagacctttgcgcatttgcgctcttgagtcgtcgtgcacaaacagaaaaacacgatttcgctcgacctcgcaccccaacaacaactaacacagtgtcatactttgcatcagtccccgcagctcccgcagatgcccttttcggcctcatggccaagtacaaggccgataccttcgacaagaaggtcgacctcggagtcggagcctaccgagataacaccggaaaaccctgggtcctccctgtcgtctccaaggtcgattctctgattgtcgccgaccccactgccaaccacgagtacctccccatcactggtctgccagacttcaccaagtctgccgccaagctgattctggggcctgactctcctgccatcaaggagaaccgagttgcctcttgccagacaatctctggaactggagcaaaccatctgggatctctcttcctgtcgcggttcccctcctccgccgctccccccaagagcgtcttcctcagccgttctcccccttcccctggagcaaccggagatactcctccccgagctgctggcggccgaatctggatctccaaccccacctgggccaaccacaagcagatcttcgagaacgtcggtctgaccgttaagcagtacccctactgggaccccaagactctaggtctggacctcaagggcatgctcaacgctctggagaatgagacccgacccggagacattgttctgttgcacgcctgcgcacacaaccccaccggtgttgaccctgctcgagaggagtgggagaagattgccgctgtctgcaagtccaagaagctcttccccttcttcgactctgcctaccagggctttgcctccggtgatctcgagcgagacgcctgggcagtccagtactttgtttcccagggcctggagctgctcatctgccagtccttcgcaaagaactttggcctgtacggccagcgggccggatgcctgcacttcatcacccagaccgccaaggcgtcggagaacgtcaagtcacagcttgccttcctgcagcgatcagaaatctccaaccctcccatctacggtgcccgaattgtggcccgagttcttaacaaccccgagctcttcaatgagtggaaggaaaacctgctggagatggccaaccgaatcaagagcatgcgagatgcgctcaagagcgaactcatcaagcttgatactcccggtaactgggaccatatcactaaccagattggtatgttctctttcaccggtctgtcgccccagcaggtggaccgactggttaacgagttccacgtttacctgaccaagaacggccgaatttccatggctggtcttaacacacacaacgtcgcttacgtcgccaaggcctttgatgccgtcgttcgaggttaattatgtatttggagtaggatagatttaatatcatgtttagatgtcttattatcgcgtatattacagcatctttaaagactgcaagcacatgcaagtaaaaaattctttttgtattttgtgattaaaaagctggattcccagcttaagctctcggcatgcacagatcagcatgatttatcaacaatcagcttgctgggcaaatctgcatgataacagcacatgcagcaagccattgaagcaaacatcgcagcaacttgtagacacgatattacagtgaataaatatttaatgagagcttagttgttagtatggaattagcacacgtcgtagctaggaaagacccgccgactcttgacgttaacacgccacgaggtgatgcccatttcggtgccgacaagcagggagcctccgtcgtaggggctccagcacatgccgctaatgtcgtgttctcggtaggtgagccgacgggactctccagagttgagggcgggcaacgacactctggaagaagaagaagaggacggaggagcagccgagaatgcggaataaactgggggagcgtaattggtggcatggtcagtgatgggggtgatttggggctcggagtccagtgaaatgtccgagcctgccatgtactctgacgaagagttggacaagtcggagcgtccggatcgtgctgatcggatggaccgctgcgaccactcctcgggatagtagtggtgcatggattttggaggtcgtgaatagtagggcagatgtagcacctggtggttggagaaatcccggagatcaaccatatgcactctgccgctgtgttcggagatgaacatgatatcttcggggccctcggagaacttgaggcatcggaaggcgccatgattttcctctcggcgtgacgagggcacttccacgagcggttttgagtgttttcggacatcgtaaagacgagccactccgtcctgagaagccacaccgaacagaactccgttaggatggaaggctgttgagaagcccgactcagagccaatctcaatcgtgtgtgtcttaacccatccgtacgcacctctgttgcacacgtagacctggtttgagtcaccacaggccaccacggtagagttgtcgggagagatcgaggcgtggtttaaagccgacgtgaagcgaaactggtcttcgacggcaaatgatgcagagccaatggacagaaagtagagcaggtgatcgttgttgcataccagggccttggtagcattgtcgtacagcgtcacggcgttgttgatggcctctcccgtgaagatctcgcccgagtaggtttctttggtggcgatatttccgacacaaaagagacccggagacgaggctggaggacgggtcagtcgagacagactgctgccaagagagggtcttcgaggcccacaagtctggtcatagactcctcctgcagcaacaatgccattctggacacggacacaacggggttcaaattggaattcaaagagcggctggtcagatccatcaaaggatagctgtcgtatggtgttgtggaccgggtagatgacagagtcgtgagacatgcctcgacccatatctgtggcatgaatgagatcacgcaactgccagtgtttgacggtcacgtgtgcagggtagaaggtgtactggtcatgtagcagtgtattctgcgcccgcagctgtgcagtgtcgatggtcatatcgagagggagatgtgcgggttgtgagaagtggccgtggttgttgacaagtagtggaattacactattacactaacaaaattacatgatattgctgcagtccattttaaccttgccatacagcataccgccttgatgtcatgtggtctgctgtgacccccaaaagtccttatctcaactttaatgcgacagatgagcccgtggttttaagcagtggtacacaggagatcctagagctgtcagaggagggctggggagtccaactttctcccaaacacccgctttggacatgtgaattcgccaattcgcatcctattcatttcccgccactgcataccccgcaaatggcggcttacagtgttctcataggcagctacaaagtacagtatgtacttgtgcagtagatgtactgttgggggtacattgcaggccggaaaactccagtcatggataaactgtgtaagatagagagagccctcgggcttgaacataaatatggcatgcaaaatcgaagatagtaaaacatggggataacagggatgacagtttgcggttttcacataatgcgacacacacactgcgactctagatgtgccaaggggggtctaaactggctcttgtctatacggggctctgcagctaaggcggcgattgtgtagagtggataatatgaggattttccttgtgacttttatcagaagcccgagtgtatttcgggtgacgagactgtgacgagactgtgacgagacattggggtaatttcggtaatgagacatccggtggagttgcttagtaagggtggaagcgcatccaccagcaggtggacaagagagtgtatgtacagtacatgacccaagaacagacaaatgatcacatatcctttgcgagtgctgtaagtatgccactttttgagtatgttttggttggtttttgagtgtcatttagtagtgagagatttgcttggcttgtcaactaaaagtaactaattaagcagattctgtagttgcatattcccactataatgttgatatgacatcgcataaaaatatacagaaggtttcatttttaaagatgaacccagctacgcagctgctcactgatatgtacaaagctgtctacttcttattactgtatagaccccccccacccaactgtggaacattctggcttacttccttcaacatgcatgaggtgcacacgagccaaaaggatgtcttctaaagagtgattcaagtcgttttgagtggcaaaaaagacaaaattcttataaaacccacagagaaaacagattatcaccttttactacacgtttttgaaccgatttaagcccgtaataccacatataatttctcgccacttctaactcaaagcgtgttaaactcagacaccgtacagggcctcggtggctaaaagtgaggtgccgtaaccaccatcttccaaacattgtcccaacacaactagccgccaacatgagatgtctgctgatattgctgtttttggcgtcggtggcgctcgcctcgttctacaaaaacagccccgtcgtggaagccaagggtaacttgggcccggtgctcaagtccaacaaaacctccattgtggagttctatgctccatggtgcggacactgtcgaaacctgttgcccgagtacgtcaaggccagtaagggtctgcgaggtctcgccaacgtagtcgccgttgactgtgatcaggagatcaacaaacccgtatgtgcccaatggaaggtccagggtttccccaccctcaagatcttccgacccttcaacgatcccaagaccggaaagaagatgcggcccatggttgaggactacaagggtcctcgggaggccgctaccatagtcaaggaggtttctggtcgaatcaagaacctaacaaagcgtctctctagtgtcgctgacctgaagagtctgatggagagcaccgaagaggacgtccaccacatactgtatcttcccgctaccaccaagaagctcgttcaggttcctcccgtgcttaaggccatcgcaattgactttgtcgatacggccaaggtctccttcgctcccggaaaggcggtgcctgatattgtcaagcatctccagcgagagtacccttctctgtccaagctggacaccaccaagagccagattgtgctgctcaaaaagggctaccatcctgcgtcttccaacaaggacatgtctcacgagggcatcctcaagttcgttaaccagtacgttatcattcgagagggcaagaaccgaaacgctcctgctaagaagactctcaaggagttcatcgtcgagtccgacgtccccgatctcactaccgacaatgactctgttgacgaggaggatgagattcttactgatgccaaggacgatattgaggtcgagattgtggagcaggttgaggaagtcacccaggaggaggccgctgcccaacccgataccgataccgacgatactgagcccgagcctcttatggcagattcaccttctgattccgactctgacaccgattacgatgctgatactgaggagatcgaggacgaaaagccctccaagatcactcctactccagagcagatcaacctcaacggcggaccagagcaccagaaggcccagattcagtcaattattgacaggtacggaggagaggagaaacaccctcgacaggcctctcgaatctactccttcgccgagctgcgagatgcttgtctcaagtccgactctcccacatgtgttatcatgtccacttctccttacagctttcagaccgacttgctgacgatccacaaggctgcccgacatgccagtgacgacacctacaagaaggtcaagtttgtctactttgtggacatcactgacgagctcgagaggcttgccgaggagcttggaatgggcccttacacatacatgaagcctccagctgacgccaagggcggaaaacaccatcttcatgagggatcttatgtccttctggatatccacaaaaacaaggtctacaagatgcccagttctatcgttaagaacgacggcaacattgtcaacttcgccaccaagggctacaagaaggtggatggcaagaagcttcctcccagatacagatttgagtactctgaccgggacgagttgtaactacaagattggtacatacgataacacacacatgctagtagtatatatagatataaaaataataatacgaataacaacaatgctaaacaggctcttataatcaagtaaaaaactacttggtaccactgtacctgtagacagtcttgccctgtttggtacaagcaccggtatgggtagcttcagctgaacgcattgtaacccacacactcttagtcagccaagaggacaaaaatatatctcagacgagcgcaaaaagatactccgcaacggagaattgaactccggtcccccgcgtgctgaacattggttctgacaggcggaaattctagccactaaactattgcggattttcgatggatttcgaggttaagatagcctatttgacgtcgcaacatggtggtcgtggctatgaggcggaagcgcggagaggaatgagcgccgaagttgttttctactctaggagtttattacgatggctggtacacatgacgtactcgtgaggtctgctcacgctaaatatacacgctgacgtctcagattaatggaattatggaaaaaaaaaaaaaaaaaaaaaaaaaaaaaaacaaccaaacaccgagctactccaacttcaactccccgatggcgcaaagactcactcaaacacgacacacacgaatcatattcatgatccctatccgaattacaccgtctacgacctattatgagaacaaactaaaccaacctcgagtctggaaaagacaggaaacgattgatatgatttcttgatctgttagccatgattcactaccacgagaccacgacaaggacaagaactagtctacaaaccaactgacatgcgcctcgcagcgcacaccgcaatgattcagaagtgtatgatttattgaacgccaataacccggcttactaggtatatagctgtaatgaatcattagaataaaaaaaacattagaatatataaaaaaaagtgaatcattggaataaaaaataaaataaaaagtaatgaatcattagaataaaaaaagaaaaaaagaaaaaagggttgatatatttatccgctcaagagatggaacaggaagaatacgtgaacaagcgaacacgaatgtcatgcgctctcctgaactaccgaaatcgaatctgatctgcgggtataacactgtcttggtctatttccctagatatttatttttttgaagtttgggactgaagaagccgcaagtgggtttaaaggtttataaaacggatctacaattataattttttggttatatttatgttactgtacctgtcttgtggtgcaatttatgaagttttcgagtcatgtctgtctattcatgcatttagttcatgctaaatagaatatctaacgaaaaaatcaactataatgttgagggtgccgaaccttttttcagtatcaacagacatgtaaactaaattccagaataataatgaactgtaacaggtgtgccaccaggaagaataccgtcagtacatcataatcacgttcagactagcttgttattacttattggtctttcgagcgtatgtaaaagtgaatttttttttttttattctaatgattcattacatgcttttttttgaaaaatctgaacacatgtacaggtaatgcatcatgttccccatagcatggttgtatagtgtagcggttatcaccttggattctgactctagaagtaccttccagtaaccccggttcgattccgggtacgacctagtcgttttcttttttatatcccggttatggtgggtgacctggtggacttgccctgcggatgttttaagcctacagtaaagctcacctttttttccatctcaggacatcatgttggaagtctctcaactaaaccttgtgcagtgaacttgggcgatgaggcatcgggcaaaaaaataccatgtaactaatttcaacaatggtttcagtaatagaaataatggacttcaagaaccaaattcactttcagattctttttagctcatcctacaagtatgtacagtagatgcgtcactctgtgccttcgacaatatgatgagtggtgcaatgctacgctgagggtcattgtcgccgtataagtacaatgaaactaagcctacttgtacaagaaccggtaggtctttagatggtggggcaaaaaaaatcacgactttcacccgctcgattgattcgttgcccgttttccacatatacttgtaccggcacatgattacaatatagactgttccacatcaacaggacagaccattgataaatacatgcatccagagtgtgctgagggacacacaggttttgatatcagatcgagggcaggttttaacccttgtttgtgtctataacccaactttttcgcaacagcttgcgctctttcctaccaatctacacgttgttcacattccaattctattggctgtcgcagtcctctgccaagtttcgctacactggagggctgccaacgagattttcaagcagctaccgcctgaactaactctttctttcgcactgccacgctacaagtagaccatcgcgtgacagacagttctaattcgtgtgacatgtcgtgtgcttgatcatcatggtatctatgaagccagccagatgcaaattgtactcacattgtagatgaatgaagtgtatggagagggagggcttggggtagcttccaattgttttaaatcggtattgctggtgtctaaataatgttgtattgctactatgtgacttgtgatcatcgtttttctgaacgcccaaatgatccaattacttaaccatcgcgatgtgaataatatgccatctttgggcttacacttgttacatctaacagtacatactgtaccagaaactacagaatcactagtaaataccgcacaaaaacatcacgtgccaggagtcagcgttggtgacgatcctacaaggtcggcccttgatctctggcaccacgtgctcgtaaccgaaccttgcccgagctattagccaagaactctgatgtgagataggcaggaggttgaggaagttggagagatgtgtttgtgcgatatcaggttggaaaagacaataaatggaaccccagacagctttggagactcccaaccagctctgttgttgtcaccaccgctttcctccaagactacgtcatcccacagatattctcgaagataaactcgttagtctcgctagcatgaactctgttcgaacagctgttaaatgagacgtggcagttgaggtggataaatgcccagattttaaaataaaacattccgtatcatttaattcgccactgaatatggattccaatctcaaccatgcaatttttgacccgcaggtccctctatatggtgggtattgctgcgcccgagaaagtctagctgacgctactataaatggaacttcgtaaactggagcgctactaactcgaggttctgacatacaactagaaccaaaaaacctgttcgagccaagaacaaagaccactaaaccaattgatcacgttacaggttgcctgtacatgatatactgctacgagtactcagccccacacgcagaaaaagtcccatcgtcaaccttgttgggattaccgttttgaggtggggatgttgatgatgacgtgggagcagatatatttgaaggaggcaggcccggtagtgactcttgataatgcgcagaagccgtcgattgacggtttctgagaaggtatagtgttcccaacaccctaacgttggcacacaagatcaacagtaagatcctataagttgctcaaaacctaaactgtagatgtgaggtttcaggggcggtctatatcagcctgtttgggcggtttcagtgaaaaaagagtaacactgcccggtttcctgagacaagctcattcgatcaagcgtactaccacgcatgtccaatcacttgacccccttttattcccgttctaagcccccttcccaactgcacaaactaggttcacaacaaccggcatactgctccaacatggaaacttggacacctggacaccactctacaccctcaattgaccatctaaaccacaatgctcaaagctctaggtctgggaaaacggggcggcgacatgcccaccaaacccctcaacaattcgaccgtctcgcttgccatcatggacgacgctctgcgggtcgaagaggcatttattgccatggacatggtgatggatgaccgaagcaaggaggctctcaagctgatccagaaggatgagcccggatcgagcggcaagtctgtagcccgagaacagtcggccttctacaagcttgttatcggagtcatctacttcatcgaggctactctgggtttcgagcctgaaagcatccgccgtgcctctgaagctttagcggaagcggaggctgcagctgtgcggcaaaagcgaaacgtgtccaacaacggagcccatgttagctattccaagtaccctcctggtaccgagtaccgagtggcattcgcagaggccgaactcatgggagccatcacgctgtttctgtcagagtcttatctggagtccgtcaaggccctctacaaactgcgaaaggcataccagacgctcgatgagatcagcaagagcatcagagagtccaagaagcccgccaagagctcggatcacaagtctactctcgattcgctgagcctggctgtttccgatgatcaggaaatggcttctttggtggaaaagttccaaaagacccggctcaaccgactcaacgagagcaataacgccactcctgttgcctcgtctgctgcctccatgaacaccactacctcttctgctacggctctccaccagggatcagaaaccattgaggagttcattgagtctggcgtcgatctgtgtttcggtattctgcagctcgtcatcagtatcattccccccacactgggcaagattctgtccgttgttggattcagaggctcccgagatggtggtctttctctgctttgggaggccacgaactatagaaacatccacggagctttggccctgcttgttctgctgcaattctacgacggtccaacccaattctccgacctcatccttcctggaactgaggaagatctcattcagcagggcaagtacgacatcaacacagccgacgataccgaaatcaccctcacagccaccataaccggcggatccggacactccaagaaggtgcatactctgcccaagaatccccgacgtcgaatgcacaagctgttgcttgccgcccgaggctactaccctcattcggctctgtggatgcttcaacagggccgaatggaggcctctcaatgccatctggaaaaggccgtggatatcatggacgctgacatcggccccattgagatgaagcaggtcgaggctctcatgttgtttgacaagaccatgttcatgctcttcctcaaccgatacgagcagtctgccaccaacttcatccgtctgattgatatcaacgcctggtctcatgcctggtacacatacgtggctgccacctgttccattgagatctacagagaaaacctgcgtgctggaaacgccgaggctgctaagaaagcaaaggacactgccacccggctgctgacagaggctcccggtctgattggaaagaagaagctcatggccaagactatgcccatggacgttttcctgtcgcgaaagatttcccagatgcagcagctttcaaagcaacacaacattgaccttgtcgatgccgcaggcgtgtctcctgtccaggaagttgtctatttctggaacggatacggaaagatgcccgagtacgctctggagaaggttttttccgaggtattggcttactctgctgctcctctggctcctagccatattcccgagcaggataacgagaagactgtcagacacttgttgcaggctgtggctctgagaaacatgggtaaggtagaggaggggtacaagatactcaatgacaacgtcatttcgcagattatcactgagagcaacaacaaataccactacaacaagaccgtgactcacaaagacccctggatgcctccttcggcgctgtatgagcgtgccatgtttgagtgggtcatgcatggacccaagggcacagagactgtccgagagtggctacatctggccgagaagtggtctgatgactacgagttgagtacgcgagttggaatgaagatcaagtctgcctttgagcgtcttgatggaggtgctcttgcttagatatttagtcggagacactgacactgagcacaagtaaacgtatatatataaaaaatgtattaagctaatagagtgatgtttgtgagtacagtagcttctgtacagctactattgccttttgttctctttttattcatccctcttaccgtagataagtacaagtacttgtatcgtacaagctttggttcaatacatactgtacgaggagtatatattatacatacataactaatctgtgaagaaacgtgttgacgtgggctcatgccacataccagtaaatctgaagctaccctacctactcatagacactcgattgacattgccaagataccagctctgttctgataccgccaagacccgctactcctacttaacagtgccacgttgttcatcctcaggatccaagtcccaccaacaccaggcacagtaaccagttgttttagccttctctttaggttgagagagagagagggagagtatatctcgacatgtccgttcgcgtcaggtcagacgcccttatatcaaaggcgtcgttgtacgctctttactgtgtatcaatttccttcggagtaatttccctgcagatgttgactctctcattatcacaactccaggtgtgcttcactcacattaaagttcatctcccaccctgcagctgccaacttacactgcatacactacagtgcgtgcacgtagatggttggggagactacttgctaacgacacctagcaaacgaacccgttttctcgctcagccgggcacataagttaggtgaacaccgctccacgacctagtcacgcgacacagactgctgtaaccagacggcctctaacatactgggttacacgagctacacgactgctgcacgacatccacgacatccgaaattacactccttattgtctcaagctgttaagagtacccgatagcacacagcgagacgccatttcaattacacgccccaaacatctctgagcactagatctgtgtattcgcctctaaattcaacagccgttccccaaacatcacagctacgatatgacttcagactcaatcagagccgaggttgtgttcgaatccccgacagtcttcggcggcgacgacgtacgggctgttataacattcagaaatgtgtcaagggtgacgagtgtcgacaatactgacacccggagtgatgttcaagccgacacccgaaacagaagcgacagctttcacaacaacaacaacaacagtcgcacggaagaccagcccagagcctccgtcgacggctggcgagatcggttcttcggcctgctgagcacagactatgagccacttccaagtaaccggctctcacgagctcgttcagtacgaagaacggctcaaccgccggtccgttcgccccacggtacctccgagaccctcattatgggcacgtgtcgaattgaaggccatttcgttgttgatcctgaagtcgtggatgtcgcccggttggaacacgttcgaaacagaggagcagcaatgggattggctcatttgagtgaagtagacgactccaaagacgtggacaatcaccaaggaattaccaagatgatctggggactactaggagacgagtctagtggtacccaaagcaaatctgctcaatcgagtgactccggagaaggccttcccatttactcaagtgcatcgtctctgctgttccctgctctaacactcaatccaggagaaagcaaagttttctattacaagtgcacattaccccgtgagctgcctcctagttatcgtggcaaggctgtcagaatatactacagtttggtagtttctactcaacgaggcgaaagccgtctggtggatcgccccgatatgtcgaatgaagataactcacacgcaaaaccaagcctcacgtcacgttctcatcgcctcgttgcacccttccgagtcttccagtacgttgatgacgacggagactcgatccctcaccaggtggacaacccaattggtggagagcagagcgccgtagcagtgaaagagctaccagactcttctcgtgagaccatgagcgacgttttcggactccatcatgttggcccaagcacaaaacccggcccgaagtcacgagagcaattgttagatcacatcaagacactccggacatcccatgatccatacgtatcgcatgaccagtccatggaagacgaggaggacgatgcaggtacctctgcaggtgcccatattaaccgtcttgtccagtccaatggcctcatcagtaagactttggtgcccaaaaccaccttccacatctctcgaaactccaagtacattgccaccttgagtctcagcaagccgctatatcgaatcggtgactctatggttctcagttttgacttctccggctcccatacaccttgctatcacgtcacagcttctctggagaccacagagactattcaccgaagttatttgcatggatatgattgggacgacagcttgttgagtggctggggtaactcaagtaacggtaatctcagctctggaaacggcagacgatcttcagtgggatcagatggtagtggacgtcgattatccggatctcgagatcccaccatgatccctctgccgtctactcgccgaatctacgctcaagagatgacgttcatctacgactcacgtgaccgtgtcactttcgacatggtcgttccggcaaccgcggcatctcaattcgccaccaccaaaatctgcatggactggtcgttgaaactgacttttgtcacacatttcgccgataaaaaggatgcgcaaatgatgggtagctcgaaaagcaaaacccccaacgctcgcagcttagtgcagaccaacattcccaggcctgcagtcagcgagcctggttctccggtgatggaaagaaagcgaagcatcgtgggcgactccgcattccccaacgcgaacgctaacggcaatggtaaaaacgttcttactaacggaggaacacccggtaatattctcaacattacagactcggctgtcatcgcgcctgtagagtatgactctagaggcacgacgtatggacccaaggatacattttcctgcgaacatttctcctgcaaaatccccctcaacgtttactccactgacaaggacatttcgtctgtgattggagtcagtcgaggcacgtcagtgtattctgccggactctggtagactatacacctatatttaatgataatggtaatgatcggtgctgtgggtttgccatattgagaagtcaggaccgataaacaaatatgccttgcctaaggttgaccccgctctgaactttccatgagcgagtacaactataccgatacaggtaagtacaccaacacctatattgttgggtttccagcccaatatagctgcgggaatgtctttcactacgtgagaacacacaatgaatgatactttgtgcaaacacaactcgttatttgacacgtacacggtcacccctacctccagcccagcccacgccaataatacacgtatgtttcagatctcctgtgaactttgcgttaaacggaatttatagaaactaccttatgatagctgtaagtggttgagaataggtgaatgctatgatgtgatttcgaaattattccttcgaggtggggaagacttatattagcccattttttcgtagttggcaacgctagcccaccttccactgacatctgaaaggctcctgcgaattgacatgagagacatggatgtgcgattgagattagacattggactgcatgcatatttttacccttggcagttgtgagcggttgttgatatttacgtacaggctttgaaaaagcaatcctataggaggaggcaccagtgagcattgccaagttaaagctggaatgattagtttacaacctcaacaatctctggcaatacaaataccagcagtatcgtcgtatcggtaggcagcaatccaacgattgcaataaaccccccttacctctaaggctgcaacagcactggctgcacagaacagacccttgcgtctcgtaaactctcgcttctttcctttgttgcttgtggcctaattagagcaagtgaagcgggtgctggttgagaatgtaccaggtgtagaaatgacccaaatgagatgataaaatgcttcctactgttttatagatgcactaacctgaaaccctgctccaaagcactcataacgtgcaacgtggatatcatctacacctccacgaatcttccttgcataaacttttctatacgaagccgatcgacaaagatcaacaagagatcaacccgagacgatgtggggatatatgggtattttctaagtagttatgggtgtttaattgtttggatatcaagtatcgaccttttattagcctacccgtttctcctatggtgtgatatatcgctctctataccaaacccccccctgtaagttgcatgctaagacaatgctgcagccagggttttgagcgtcattgaaggtggcggtataaatacctttaggaaaccgcaagctcaaataaaccacaaatatctcaaatgaacacctcatacacagccggaattgtcacagcagctgcctttgatccctttcagtacgctagttgtgtggttacaccaatatccactgctcgaactgctccgactgctcctgttattaccctgtgggccaatatggacgctagagcctaccccatttgcataggtgatgaaatctatggtacatcgagtgcctctaacgccacggccacagtcaccacctccacagcaggaagtacaattactctttatggagtccccacagtgatcccaccagaagactggctgagagccaaagagagtcaaaatgtccagaggatcaccccgcagaccagcgaagctagtgatgctagggtttcgattaaccagattgttctggctactttagtcacatcaattgtgctgctattttgatctcatagagatgtatggccagggttcataggcagctttggttgggaggttcgacatataggcagggttcagaagttttagaggttaggagcaagaggactagaaggtcagggaaaagttacagacaaaccaacaggtaattatatattcaattgactacacgggaacgcatttgtagtcatatgctgtagccacagttgttgttgttgtaaatcattattaaccagtctatttttactacaacgtagctaccgtacttgtagaaattccatctctcaagcccagttgggtgatgcttacataagcttgcaacgataactatcgaactatactggagtgactgtctacttgtacagtactgtactcgtagctctattggtcagatttggtgtacaatacaaccggtacagtacatgtacggtatatgatggatccattcaataaaaccagtcaccgaaaaaagtcactgcgcctttgaattagttgcagaacctgagtaataattaaagttctaaagttgctcagtcgccaaaaccgttttattgaggttagggtagactgtccaaacaggcaacggttccgcacgttaatgaaccgggacgcctcggcccagcccgggataaactgatgcaacggacatggccacgaaaacgtgtaatgagttgagggagtctcagataaggacagggcagaaacaagcatgttcgttgagtcgcgtgagccactcagagaagtttttcagttgaaatcgcacgtgatttatacgtgttggtgtaatcatcttagactacaagtagagtaaaactgaggttctttaaaacatcaatggtttccgagacacgttagtactgtgatataatggggtattttcaaggacacgaataagagacgactctataacagcgacaaagacttcttcatttgctactgttttgagggctttagataagacgatattctgcctgtgatgtcgttaccgtccaaatagttaaaatttcggaactctaaaatttcgagcttgcaccttatccttatccaggttgtttgtgctgatccgataatgaaaatggagtagctacacgacattggtgaggtgtgaaatgagcgatgaggtgagcgacgaggcgtgtatatgcgatttatggtggcaaataggagtgtttattgtgcaatcccggcacaatttacttgtaggtcgtattaaggtggttacaagtagtagctacatcacgttacaagtggatatatcgactacatacaagtatgtacatactggtcaggaacaagaatttcaatatgcgatcaattaagtaataaataggtgttagagagacatgctaggacgttgtttaagcgttctgggtctgggtggtagaaggctgagaaggcttccaggtgaaggagtagacaccagaccaagaggtccaggagaagtcgacgtgatcaaatcgatcgaaaaaggtggaagtggctcgagaaggcatggtgagtgttttgtgggtggtatgggagcttggttgggtgaatgagtgctctaaaaccaggtcgatcgtaagatgagaagtgggaaggtgtatttgatgcggaaatagggcagagatgatagtctatatatacttgataggaaattcagtcacacgatatcgaggctgattgctgcatatcaccgcatggcacttaaggttcgacggatgtgctataatagtctaaaaaaacgtggcttggtgggaggtgtgttttgaggacgttgtgattgattgattcgaaagttgaaaatatcatctgagactcaaaaattttggtaacaatttcatgtctttggaatcagaatcaacgcagtcctcatggttctagcaatcattgtattctgactcagatactaatgtatttcatattagagtcattcttgagaaacctagtttaccgtctgcaatcagtcactacttttcatttatcgccatacatacatatcttacatcagttgggagatagtcacaaagcttatatttagtggttcagggtccatgtcaaaccaaacttgatctaatgttacagtagcgttgcaactaacggcatctataacgttgattacataagcggaccttcaggacaattggtggtgagctgatgacacggcgggatttctctctcaagctgaggaaatcccattattgaacacgtttgttctgcttgtacagtacatacgtctaaccccacttggacagcacgttacattaatgctgaaggcatctttctcactcagctcaacgtcttttttacgtgttttgagttcgggttaacggagtggtggggggtcggggtctcctgaggtattgggtcttattgagtagatatatggcacatggaccatatctatattcgaatttgtctggtgtattcatatcttttgctcgtttttttcaaaactagtgcattctacgctctatagatgactccctcgcccaacaatatccccccccccactgtgttcacacccgccctccgctggtccaggataggcaattttgatcgcatcggttagcaggtggggaaaacctcagatgtggtggagaaggggatgctcttcgacatggggaacaggacaaggagaagagagaggctcaaagtagaccagtgataggttggctaggtcgtggctgctggtaagacgtcattgttgcttttgaaattgacacaccatgaatctcagaaacaagtatgtaatgtattttttgtgcaatctaccgccttgtagagtgttccgttagaccttgtttcagcttcttacagatgcgtttcaccttctgaaacttccactggaccttgagatttccattagacccaaacatgttaacaccttacacggttggccttctcatagaacccttttcaaccccacaagcaccaggaggaaacaagtcaccacggtcaataagcgcaactcgacccttacattaccaaccgttcatctcagcagctcttcgcaatgcacccgcaagaactattgctggcacatcaaaccagtcatgtgaaaatgcgaccggctttaacagtgtccacactggatcgttttcgaatagcgcagttagaacaacaccgctgaacgctcccagttcctcagctactgctccgatgacggccattacgcttcaatttaccatacccacgatgccagtcaccccacccttcccatatcaatccttttagcacgctccattccagactgactatgggttgcaactctgtcctggctcctcaagtagcagcccctcaagcacagcaacagtggcagccacattgtcaaaccatccacattctgtacccgcgagtggagcccgccaacagctcgtgctgccataccatcctccacccacatcacaggttcaactcccagctttaggccgtacattgccacgttcaggtgcaagccgcgcccgatctcccagccctgccgcctatagaaccgattgcagtgttagcaccgccagctactcgctccccacccgattaccaactctaccacacatacacgagcacccctagaaattctcctgctactgttctactccaatgtgactatgatgagctgagagagaagaccgttgagcttcgacgagaatcgagtccctcaactcccagaagcagtattggtcgagggagcagatctaatttggaagaaactggctgttaatttaactcgaaggactctgcacgttcgaggctgcccagaaggactactttgatcgacttgaagaaacagcttacactgagaaagctggaataatgggccctctgacccttctactaaagccggaagaagtgatagcgaccatgacaacggggtgtactattggtgaaggaacgtgctggcgaacgcagctatgtagtagaggtgtctatgatggggcgggacaaagctgacgagtattagctgccagtagactgggttttgccgaatagatgtagaaagcgaatgaaagacaccaactgacccagagaacaagtatgtatagtagcacttgtggctaaagttactgtaaagcctttgcaatgtcactctctactatgcaatgataattgattctcaagagaaacataattaaagctagcgataacctcactcccacgaaacacaagggtcgagtgcatacttcaaaaagtaacctaccaccacatcatttaagatcaggacaggaagaagtagacaaaaaatgacatccgagagattcgaactctcgcctccggagagaccaggatattgattcagttacctgaacctggcgccttagaccactcggccagaatgccaaatcgtgcttttgtttggaaacaatttttgttaagatcacgactgcttagtcatcattgaattattagagaaaaaataataataaaaaaaacaaaaaaacaggacgcgtgaacaagtaaacacgaatgtcatgcgcttttctgaataaccgaatccgaatcaaaactgcgggtataacatcgttttagggctcaagaaacagaaatggatttccttagaataggaaaaaaaaacatctaagcttcgagaccaagtcatgaaaagaaataaactgcttcatctaaagatataacgggtgtgaaaccagattcttcagttcttcaaaagaactccactcaaaaaaatgtcaactgagggattcgaaccctcgcctcttgcgagatccgaaagctagatttctcttgctaagtttacacttgagtcggacgccttagaccactcggccaaattgacaggattctgcaaaaagagaagtagtggctactactatcaaatgtctgattctttcagcacacatcgcaaagattcagaagtgtatgatttattgaacgccaataacccggcatactaggtatatagctgtaatgaatcattagaataaaaaaaaattggcgatttttgttcaatttcaacatattatggtacgctggctccatagtagttgattccactcatttttgcacctcttacatttatacttttcatcagaagagagacatgacttttgagtcagatgtggtcgagtacgaaaactttcgatgctttatatgaaattgtaccaaaagatacattagagtcaaattatcaaccgcgttgacacacaggagacgtcaacatatcagaaagaacaatatgacgtgattatgaattgttagtctgctcgttaccccacacaagacgccactcccaactttacccgcagtcccgaacaacttaaagcaagagttgagtaatcatctcagaaatggagcagcaatggtacgacagtgacttcttattttattcgaagtttttatataagtaatgcatcaattggacctttccacttgagtttggcattctctctcgtcagaatatctatgatttgcgaggttacgagggagatccgacattgcatgaaggcgcatgagtctatgtgagcagtgagattataataaaccatcctttggcaaccagtacctcactcacccaccccaaccgcaattaccgacattatgctagcagtcgtctctgaaaatcacaagctctatcttcgaaatacgccaaaggcgaagattgctgctcctaacgatattctcgtcaaggtggattatgccgcacagaaccccattgatgtgattcttaatgacaacaagatgttgaaagatggcaagatatcaggaaatgactttgcaggaaccgttgttgccattggatctagtgtacgagatcgaacgctggtggggaaacgaatcgcttcctttgctgatggtcacaacaatgactacccttcgggttcctttgccgactacgccattgcgaaagatggtatctatacagtgctacctgactcagtgagtagtgtcgaagccgctacaattcctttagcatacgttactgctgtccacggtctttacacctcggctcggctcgatctagaagggaaaccagcacaaactattctcgtatggggaggtaactcgtccgtgggtagatatgcactccaactggccaagctcaatggccaccacgttctcactacagccaacggaggcaataacgaagagctgattaaactcggcgcggacaaagtgtacaactaccgagatacagatgtggtcgacaagatcaaggctgattatggtcccatcaagtatattttcgacgccattggaacagcttcttcagcttctgcatgtgccaaatctgctgctgatcccagtcactacaccactgtcagaccggatgcagcacatacaaaagaattcccgagttacattaccgtttcgaccatcattgtgtaccaggtgttcttcacagatacggaagaggcagttgttggagataagtatctaacggatgcatatacgtggctgaagagcaaaaagctggtctgcaatgttccaaaacttgttggaggcttggacaagattgaggaaggataccagcttcatcgaaagtaccagatcaagggagtgaaactcgtttaccgagtaggtgaggtggggcgactctagctactagctatagcataggtagtcccaactattcatctgacatcataatctcttggtgtgcctacagatgaattttcactgtgtccaacatatgatcgtaatagggcgtaattagccactgaaagtaaaacggagtccaaatatcatacaagtgttctgtagctactttaagcactctttgccgcattgtggataacatcactgcgagtgtcacgtaggagaaagtgtctgttatctctgcttatctacacctctaactatagaacgagcaaataagcgaaatcctgaagtgccgtttataaaaccccttgtgtctccacattttagtgtgtttcgatgcagtcttgtggaatgccgtcaaccaccagctcaaactactggcatgttgaagacagattaacttctttgataaaactgagttgttttaaagaactaacagttttctcgtgatattcaacgtcttggtctgtctgttctggtttcccatcataatctcttcacacattttctgtgttggctatctactgtagcctgttctacttgcttacttcgaagggagcagtacagtttagaatttactgtaataccttgtttgaggtggcaaattctgtcggatgtttggaactggaagaccaaggagtagctctaatgattgttagtcacataatcaaactaattatcgaatagtttcatgttatacgaaaattagtacatccttccaccacccatcgccacatggaacaaggtttgcactaatttcacttccaactttattttcacgtgatatatactcacgatgatgcgcataatgcgccatcgcagtaaccacgagtcacactacctacacgaaacacgacccacacacccacccacaaccacagcatgtgtcgatttctgattttcaagggtaagtatgtcaaccgctactacacaaacacccaaaactaacccaggaaaggagcctattctcttggctcatctactgacccgcccagcacattccatcatcaagtgagtatatgacagagaccgtgatttctttaatccgagtatgaaaactaacgcagccaatcctttgacagtcgtctgcgactcgatatgacccggcctatcaacggggatggttttggagtcggatattacaccatggatcgtgatctggaactagacgctggaccctgcgtcttctgtgcgatcactcctgcctggaacaacaccaacctcgcccgactcgccaacaagactaagagtgaccttgtctttgcccacgtgagagcctctacttccggtactctctccgagaccaactgccacccctttgcctaccacaacttcatgttcatgcacaacggaaacctgagtggcttcagcaaaatcaagacacggcttgttcggctcatggacgaggagtacttcaacgttatcgagggaggaaccgattcagagtgggcctttgctctgttcctggataccctgaacaaactgggctgtgatcctgctcgaactgatatccaccaccctcatgccaagattcgagaggctatcatcaagacaattgagatcatcaaggaggtcaccaagagcgttggagtcaccgattccgagcccagcttgctcaacttcgccgtcactgacggagagacggttgtatgctctcgatacatcacttccaaaacagaggaggctgcctctttgcatttctcttcgggatcaagcttctttgagtataagcctggccagtaccgaatggagcgacacgacaagtcgcagaacattatcatggttgcctctgagcccctcacttttgagagaggagactggatcaccatcccgacaaacaccatcgtcacactaaccaaccagaacgtgttgctgcatcccgttattgacgagtactacgtgaaagaccccactcatcgacgaagcagtgctctagctgagtccaagggtctggcttctcctgttcacatgatcaacaaccctcctggggtgcctccactgggaagagagggacgagatattgttgaggaggttattgcatgagcgggaggacgaagagaatatctatacaccaaaatgtaaataatagagataatttatatagtaaccaatcaactgtagctactctactacaatgtattataacgatgttcgtaccatcctgtagtatgtacgggttgtgccgagacgctgaaatacagactaattaactcatattagggacgccactaaaatatcataacacacaccattgagtcattgtgtttaaaatatgccacagtctacagtacttgtagctactcgtactgtccctagctactaatgactataaatctacccactgtaatacacagcgtaaaatcacccttctagtccaggttactcttaatatctattatatacacctcagagttgttgtttacttctggtgggcgagccagtcgttgtaggagccggggtagttggctcgcagctggtagccacaggtctcagcgagagactcggcctttgcggatcggataccagcctggcagtagaagacaagctcgtcgttaatgtcgggcttggggaaaccaaaggttccctcaaactcctcggcagacagagacagagctccaggagtagacttgacggggatgttgatggctccggggatgtggccggccttgaactcatcgggctctcgcacgtccacgaggatcacgttgtcgttgtcgcccttgagaatgttgtcagacagggccttgatgtcggggtaggtaagttctcggcattcagaagacagggcggaatatcgtcgcttgagcagctgagtatggaagttgtggggcacagcggcgagggccactcgggcggagttgagctgggacacggagtggacctttcgggtggtgatggagttgacaatgggtcgcagagctcggcctcggattccgagggcgtgcttggaagcgtctcgagcaatcactcgtcgagcaacgggtgtaattcttcggaacatcatataaaaagtatgcgaagtacgaactttggttgtgtagtgtagtgttgcaagatacgatatactggaaaatgcttatcttgaagattgctgggaggaggaggagggggacagaccagagttgggcggagctttttcggggtgtgtggagagagcccccagggggtaaatgtgttaataagagtaagtacaggatctaataaaagtgtctaatttacagatccctaccacttcgccatacccacgtaatacccttcttcaaatctggccagtagagagctccagtcacgcctgaggttataaatatgcacactatgtgcatgctttgttgtgagtggtttgtggcgatcgacagctagttctcatagatgacgggggcaaaaagtgctgaaaactatgcataagtggcgataactggtgtattttgcagagtatcaccttcaattaagccgctgaaaagatcatgttcgagctttggacattaattgagctataactgactaccatcctcaatatttttacttttcgtcatgtagtcatcaatcaccgccttaaaaccgccgcacgtgttaggttcagtcatgtgatgcaaagttatcactgtacgagtaccgtacgtataattatcatactggtgctcagacccaggtcagataggatggttgtacagcgcgggcattcatactcgcatatatacacttgagctggttataatgagcgcacaagtggtttagaccaccaaaacttttcagctaggagggctggtttcacctaccgccgtttctttagtgggcttcgtgacaaacgccacactaataattgggagtgcgtcattgcgcgtttggtcataggggtgaaacttcaacgttgaaattatcgtgggtttttgcagaaaactgggtttctgtagtacgtcggtggaatacagaataaaacaggggtgcacgatttcaatctgtataatttcttgtcccctcagcttttgacaacggcatatgaaatgctgtcaatctggcaaagcggctttcattatattgcaacctttcttcgtcgtagctcgctatgagtagctattcttactaagctctcacttcactacagcactacaatcacaatcgtcacagtaacaataacttagtatatacaaacgccgtcttcaggatttaggcgtcaatcttctcagcaatcttgagcttctgagagtgagaatcaaactgacggctgagatcaacaaacttgcctagcttggggtcgaccttgatcacgtggccgtccttgaacttgacctcgatcttgtcctcgccgtttccggcctcgggcagaaccttggcaacaattttggttcctccagtcttagcagacagaggaattgctgcgagaaaagttcgagcggtgtgagctgggttagtggatgctgaagagtgatttagcactcagtagtgctcttggaatacagaaatcacagatatataaacagagcctcttgtgacattctttgaggggctccctatcgtaattcagtccccatcgtccataatctcactccaaactccggatccgtgctcacgccttcgtgcccgataagtaataatccgtagagaagagcggtgaacctgccgcggattgaccgcctcgtcgataatactcacctccagcactgctggccttgaactgcacagcaatattggtgaaatacttggtgatcattttctggtgttctttcctgctgcactgtcgctcaagtgaaaaatcgctgactgaaattttaaatttcagatcacgtgcagaagtataatggcacacgttgtttcttatgtgggttaactgattgggaagttgtagttgggtatttgttatgaaagtcgccgcgatattattgcttctgtataaagtaggcaatacggtattgttaatgagcgtatattcaaggtcccacagacccaatggtgctatcaaatattcgacatcgttacaaatttaagcacactggaagctcttgaagacgccgtgccactgaatcgcgttgatgtctctactccctacacctaaacttatcatcaagcatacacctcatgcacactcagcacaagtcacaacctcagtcacgccaacaacatgatcgaaagtgactcagacaccagcgacgacgctccccaggagtacgtctcggcgtctgctaacattcctgcgcaatttgaactcgccacagcacatatgaaggctactccagagccccaaccaacccaacagcccgatgcagaggcgttgcatgatgatgaccccttaacgaccacacaggaccatccaacgggcccctcggctactgcgtccgacacaatcgactccacaccgcaaccaatggctccggccactctctcagcttcagctgtgctcccttcacttccttcagatacagctgccctcctagagacgttctcacaacagttgcagcaatcaaacgtcaaatgccagcttaaattccgaccaattggaggagccacgccttctctaaagcaatctgtgtacaaaatcgccgagactcagcagtttggggttgtggtcaagtttctgagaaaacaactgaagatcaaaaactcccagagctcccagatattctgctacatatcatcgtttgcaccgggactagatgagacggtaggctcgttatacaacagatacgctatcagaggagaactcactatttcatactgcttgaaccaagcctttggctgattatttattcaattgacgactaatgtgaaagacgacatttgttgtgcttgtatagagacgagaatgccattggcttcgtactttaacgacaagcagatctatggttgcgttccatagaggggtgtaatctcaaacaatgatgcgactgacctccgacaacccgtatcaaaccggctggataggaagtggcttttaccgcgccccctataagtgatactttctaaccgtggtttgagacaacgcacagctgatgataacttgcaaaattccttgtcttcctatctcgtgtctctatctcgcatgactcggagttcggtttgtaatctttggtcagaccatacataccacaaacactgttcgttcatttgttggatccctaccgctgctacaacgagatgaacccataactctcaagataagtgaataatataacaatccgagataagtcgagcctgaatccgtgtagactcggtgatgttcacacgcccgtgggttgtaaacgcaccggacgttaagccagcctagcctattatcatttgtttgagcggtctttacagtctccacatcaccgcactaacccctttcaaccccccacccctccccacctctacctctacgtacattcaacccctaagcaggtccctgtgatgttattttctttttcttagcgcgcctagataaccagtttagcttagagcagctatgacgttcagccgcatgtgttagtttgtggggagaacacagcaaagggtttcattcgcctaaatacattttattgacatctgtcatgctcggaaggggtcgtaaagttgtgattcgagtggagggacatgtaccaatggcgatatctttgatctcaccttacatctatcgtacagtgtacggtgacgtgctcgttaagctagtcttctattgtagcaccccttctatgatctccctttcttatctgcgaagctaacgctatcgttcctcgatgttaagggacgaaacttaactgtggaaatgccattatatatactactgtagtggttcaatgagtcttaaacagcttcggtgatctcgatctctccaaccacgctatccagacaatgtccaaacagccaagagatcctccaaaggtcaatataccaccactctctaaacgatctccaggatgccctttacgtcctacacagagctcccatgagacagacgtgctcggggaacagattcaaggttccctggtaaaagcgtccaaggaggactacccagggtatctgaagactggccctcagtctactagaaaggagtctttcttcgatccggacttcaaggtcatctccattgaaactggcgttgttggttctaaagatgacatatcacccggctctgaacctcctggcacagtccttctggaaacaaccctcaacaataccactcgtcacccaactccctcttcagaccccaatgatccactcaactggaaaccatggagaaaggcgctgaacttcttcctcgttctgttcttcacggttgtggctttctcatgcaattgtgtggctacagcgttctggggacaactcaacacagaactaggcttctcctttgatgagctgaacaacgggtttgctctgggcatcggaggtcttggaatcgggtgtccattgtttgtgcctatcgctgtaaagttcggaaagagaccagtttacctagtcgccacgattcttgtgatcgttgccaccttctggcaggcaaggatgaagtaccttcacgattactacgctgcttcttttctcgaaggactggctacgtcgctctgtgaagccatgattcagatgactattgctgatctgtactttgttcatcagagaggaaccatgaatggcatcttcatgatcatcattgccatctccaacttcctgtccctggttcccgcaggctatattgctaccaacataaactggaacacctgcttctggatcttgggaggtctagggagtggtttcttgatagtttccgtattctgcttcgaagagaccaaatttgagcgagcagaggatgatccaagagatatacatgaactccatccacctcaaggcaagatgaagtggcaactaagaccttacactatcactactgggtcatggggtgacttcttcaagacattctacacaccttttgtcgttttaatctcgtttccgattgttctctttgtaaccttgcactacacattcatgctcacctggctggcaatgtgtgctaccactcttgcaaactcgttcactcaacctccctatgagttctccccagaagcaattggaaacatgaacatagctccatttattggtctgttaattggctctttctatggaggctggcttaatgacaaaagcatgttgtatctcaccaagcgtaaccatggagtctatgaaccagagatgagactctatatgctcattcccatgtgcctcataatgaccgccggcgtattcatgtttgggttgtctattgccactggaacacattgggcagttccaatggtcggactgggtgtttttgcagctggttttggggctaatggaagcatcacactcacttacctcattgactgttacagggatatgatttctgatgccttcattggtattgttgtggtcagaaacatcatgtctatggttgttactttctgtctttcaccttggattgatttgaatggtctcagaaacgtcttcataatcgctggttgtctatctctcgttccactagttgtaacaccgttcatgatcaagtatggaaagcatctgagacgcctgagtgcagataaatacaacaagaataaggggggtatttagtatttattgattaaattaaattattcgtatcaatttcaaactacatttgataattggttgatgtcgaagtccgtattccacgttcgcgatcatgacaggacaggtttgctcaagcatgtctcatcatgtaatgatacggacctttggagcgttgtaactgattacgtgattacatatgtctcatgtgcatagtatctatgatctcttatcactggtatctttcgaatgataccaaaaacatatccactgacttcgtggttctctattttcaggttttgtttcctcatttaattctataattattaattattttttattctaatgattaaaagttgttgtttttttttattctagcgtcacgtgatcaattactgggggttataatgatttaacgctcccgagcctcaccaggcaatttgtccgagtggttaaggagtttgacttgaattgaactattctagttatcaaatgcggtttccgcgcgtaggttcgagtcctgcaattgtcgatatgtttttggagttgttggaaacttctttttttggtgtttatcgtacgtacagtacagtacatgctgtacatgacaatgcagccaattcttctattttgatacagctattgttgctcatgtgttgataggcacttttctcccgacaggcaaacatctcttcttcattagattttccttacgatactgtaatcacaacatgtgtgcaagtgtcagagtgcaactacaagtatcgtatgtctggggagaagtactgtagggactctggtttatgaccaatatcattatacacgcccatctgagccactagattcttttttatgctacttcaggtttataaacaatgttatacccgcacatacgattcggattcggttgttcagaagagcgcatgacaattgtgctcgcgtgttcgcgtttttttcctgttccttctcttgatcggataaatatataaacaatcaagcaaagctaaatatttattttttttactctagggaaatatatatatattattttttgaacatttttcttttcaaatactcaaaacgcagcccggaatctcactggtagaggacgtggcgtaatggtagcgcattggatttcggttcttcagaacgacgtcctccaaaggctgcgggttcgagtcctgtcgtcctcttcaatttttgcctgccagtgtatttctggctagtatttcttctctttttttgatcctcgtgatgggagacatgcagaaaggtgtaagagttcctgcatgaagatgcaaccagctgggtaagatatttgggatgcgcatggcacctgaagcagttattgcacagaggggaagacgaaacgtctttatttgtgcaagtacttgtacagttgaatttgtatatacccttaagcattatctcactagacatacacctgtccttgtacttttacactgtagtatggtctcgaatccctcagcttcaacaccggatctaagtttagctgattctttatcaatgatttttttttttctgcatatacattcatttaattataactttgctgtgaaagaataacctttgagatgaatgtacgcttacaatgagaatacgacacaactcaggcaccctaacgcactcttaagtagaatgattaaattgcatagaatgacaacaatcgacgaccattaagagctaccataagcaaagtgtttctgattaatagtgagctaactatggataatgtgtctgtttgattgacctcgattgtgtagctggggtgacatcctcagatgcctgcctgagacacttgatgtctgacacctgcagctacttgagatgaagtgctaatacactggagataatcgttgtagtacccccataacttctcatacacaccagattcccctcaattgcctggaacaatgataccagtaaaatcaccgtaaatgccgtcaatacaggatgatttgatgctattgtggacaacaagttccacaagctaccgagttggtgccactattgctacctcaccagcgaaatttacctcgagttcgtcgatgccgtccacaagtcccgaaataagctggcaaatgtcaaagatctccttacttggaagaagagcaaagttggtgcgatttcgatggtcagatcataacggacaacgtcccatgtttcccacctccaatctcgattcctgtgttctttatagttgaggagaggacttaggaggtctcaacgatctcggagacattagacattttcctgaaaacacatgtcgtacctcgagcgagccaactacattaacccccaaaaaccccccacacatcgcatgcccctaagatgaaagcctaacccacgttgtagaaacccacttttgccacccaactttgcactccacttggttgccagctgcaagacccgaaataatatataatacgctccttgcagatagcagatagagcccaccctggagatcagccgctccaattatgctgtgaatttacctccagtgaaaccagcctattttagaacgatattttgaatcgttcacacgacaggggtcactttcatacgactcgacgtgcaattcgcgttatagcatcctcatacccagcctggcaggtttatgatgtcttacaagcatctccaataaaagagaaggtctcagttacgcactgaacttgcagctttcatgctgtttctaccattgtcccaattgaactgagtatgtattgaaaaattaggttgagataatgtcgtcatttgagaggtttcgaagggcactacagattgtcagacactggccgtgctgaaatcaatcgatgatgtgaatcaagcatactgaattgagcagactacccttttcaaaatacatccatcacctctcctccaccaatgacacccgttcaaaacctacaaggttcagtggcgactttagttccatgagatataaacccttgcaatccacggaagctactatactcactccactcagtctcttacgcaacgaccatgactcgatccaagttcaccgaatacaaacaagtgctgcgaaacagctgcgtgggcaagccccaatacaccgagaaggattaccctgatctcgacggaaagaactttcttgtcactggagccactggaggagttggtctggaggccaccaagctgctgctagagaagaagagccatgtaatcatggttggccgatccaaaacaaagtctcagtctacccttgacgagctccagaagacatactcccacggtacctttgatttcgtcgaggctgatctgtctgacctgaccactgtggagcgagccggagagtacattcgaagtaagtacaccactttggacggtgccattctcaacgctggagtcatggctcccccctatagcctcactccccagggccacgagtctcaatggggtatcaatgtggttgcccattttctgctgtccaagtatatctctcctgctctgatctcggccgcccagacagcccccaaggacaccgtgcgacttgtctgggtgtcttcttctgtcgttgccatgagtccttatgaaggaggtatcaagtttgacgatatcaaccactctaaggtcaagaacccttctccctggaccctttactcccagtccaagattggagatgcttacctggcttacctgtggtcgaaacaccatcccgattctggcgtcctgtccgtctctctggaccccggtaacctggcctctgatctgtccagacatacttcttggctctccagcattaagaactacgtgctgtatcctcccaagtatggcgcctacaccgagctgtctgctctgctgaacccctccgtcaagaataacgagcatctcattccctggggtattgagggacaccttagacaggatgtcgacgatggacgacgtggaaaggacggagaagagctctggcagggtctcaacaaggatgtcgagggcttctttaaggaggagtaacagaaggatgtacctgtactacgagtaacttatatcactataaagagaatccatatgtattatttcagtgtgtatattcaacatttttttactctatctcattttcgtacacatggcgagtttttttacttccagtgacctgagatttggatatgtgttcaccccggccttactgttggcctccgaacttgtttctccactcctcaatctgcttctcgtcaattcgcttgaacaggtaagcagccttgccaatgtgatggccaccaaggatgtcgatggtgaactcgtcgggaattcgtcgagcgggtgcgttaagctgcttgtcgatggattcggcagtctcgggcatgaagggagcaatgacggcagagacaaggtggatcaggttaagagccacacccacaacggcagcagacttggcagggtggtcggcaaacagagagttgtcgagtttattatcctgcaggaactggttacctcgagaagagatggccatagcggtgtcctgggcggacttgagcttggtgttctccatgagggtgttgtacttggtcagcagaccgtcaacgtcagccttgagaagagtgaaggtgtcgccgagctcagaagtagagaagtcggcaacgacaccgttgtatttggcgttggagaacttgatgactcggttgacaaagtttccgaggttggcaagcagctcgctgttgtttcgagccacgaagtcgtcccaggaaaactgggtgtcggaggactcaggtcgagcagacagcaggtagtatcgccagacggaaggagagataccagtgtcctgggcgttgtttccgaacacaccgactcctcgagacttagagaacttgcctccctcgtactgcaagtactcggtggtggacagatggtggagcttggtccagggctgcttggttccgagcagagtggcagggaaaatgacagtgtggaaggggacgttatccttgcccatgaactggtaaagatcaacattctccgggttgttccaccaggccttccagttctcgggggagtagttggcggtgatcgagacgtacccaatagtagcgtcgaaccagacatagaggaccttgttcttgaagccctccagaggcacgggggtaccccaaaccaggtctcgtgtgatacatcgtgggtgcagctcattgttgagccagccgtcagtgatggttcgagagttcttggaccagtctcccttctcggcggactcttgggcccactcaacagtctccttttgcagcttgtcgagagacaagaagatgtgctccgagtctcgaacctcgggggaagagccatcaagcttacatcggggcttgatgagctcaaaggggttgagcagagtgccgcaaccatcacactggtctcctcgggcgtcctcgtaaccacacttagggcagataccctcgacgaatcggtcggcaaggaaggcgttatgctgagtgcagtaaagctgggtcatcttctgggcctcgaggtatccgttgtcatgcagcttcatgaaaatatcctgagcaatctcggtctgcttgtcagtggtggtccggccaaagtagtcgaagccgatctggaaccagtcgtagacatccttgtgaatcttgtgatacttgtcacacagctccttaggggtcaccttctcttccagggccttggtctcggtggcagttccgtactcatcagtaccacagatgaaaagggcgttgtaatttcggcccttgcagtatcgggagtagacatcggccgacagaacggatccgataatgttaccaagatggggcacattgttgacgtagggcagagcagaggtgatgaggatgtttcgctggccggggacaggcttaatgacctcgctgctggacttcttggcgtcgaaggactcggacaggttctgctcgccggtgttgagaggcagatcaacgggagcagccacggccttcttggccttcttgactttgactcgagtgattgcctgggccagagtctcgttggaagcaagccgctcgtcaacccattttccagcctcaccggacttttcgttaagggcaaatagagagccgaaaacaataatctcctcggcagatccagacgtgatggtggacagcttgagaatagactcatccagagacgtctgggcctggccagtcagaagccggtagatagtctcctgctcgtacttgagcaggttagattcaacggtctccttggcgccagcaaggtatcgaacaactgagttgggctcgatgaggttggtggagccaacctcgaggaaggggacggtgatgttgtcatcctcaacgataggggttttgggagcaaatttgagaaccgcagcgacggtcttgaccacgccggaaacgccaacagggcctccagcctgggtgggaatgtgcagtttggacatttgtgtgtttgaagatgtgtgaaatgtgtgggagatgaaattttggagtcatattagagtttcgattagggttgggggttgtgtgaaaaatggaggtggaacgggtgtgaaagaagggtaataggggccaatatcttttcaacatgaacgggagaacgtttctactgccacgaaaaacgtctatactgtagcaacatgacttctttgcattcttccacagtatttatcgcctcacccaactctccctctccatgactgatagatacagttaaggctcttggtgggaccagaaggcaaccactactgagggatttggcagcgagcggaagtcctcggaggcaaggtaggtggttagaagacggactggagaagtgtttcatgttctcttttcttcccaaaatcagaccctctcgcagtatcaatgtacctccgagtccctcaatgtgatgtgcctgcagccacttagtttaagttatacgggtgaagtggagataaatagatggccgccatggctcatgtcacatgtctggtgcagtcggtggagttcaagcgggggtaatagcgcctaccgggtggtatcgtgctacttgcttcggcattatgggggatcctttgagacattttgagttctccatttcctgtaggttgtggttgtggcttgatcgtgtgacaaagtagctgagataagaaactagctgttggaatataacccttagtcggcgagtatctaacaagtcaggttgattggtttgttcacagacatttttcagggaaagacatttttcagggaaatgagcgcgtgtgaattccgacaaaccacaagttctttctccgggcatgtgggcccattggtgtcgccataattgggtacttctctgtatctcagaatgggtatctggtcggtgaagtgtcatgtatcaagatgtgacgttccggatgacactgctatcttcatatacaagtacggtcaaaaaagaagcgtctatacttgtagctgcgctctctttccactgcttagttgtcgcaacagagttttcagccaggaaccttggtggagagctggggtaatttgcggaccatgtatctcgtcaattgccggggttctgatactatgatagtattattatcgccttgaccatagcatggattgtggtttctttccccactcaatcaattggttgcgtaatgatgtatgctgagatgtgaggtgaaggaagggtaaggtaagagggcaagtcaacttgcagagcacaacacttatcatcgcgaacatttgacatattcgagaggtatttttgaataggaaggtattaccaaaccaatatataatggaaggattgatctgagagtttcagataaaaaaacatgaatccaggcgaaccacacagcacagtcccaggtacggtacaagaatgtacagtacatcctgtactcgtactgtactcgtgggagtacgatactgtacctacagtatgtacagtacatactaaacacgtggaagattaggaagagcacctaatggaggaccacacacagccactcattggcaatattattgccctgacgctctctcaatgctgttcatgcccccgacatttaatcttttctctgcaagtctccagacctgcgcggcgtcgggtctggttgaataggcagtcttacatacagtaatacaatgatggtgcctacgacgccacgacagctgctacattcaacttacgagcatcccacaattaccgtcacggttcgtttacgggtcaacgacgcacattccatcttcgtgcgagtttacactgaaatcggtccagcatcacaatcgctactggtcattcttgcgtatgtactgtaccggaactgtacatactgtatcacatttatacatggatcgagaacgaacgaatgagtccattcccagtgttccatctacttatacttgtacttgtacgatgtgcaaatgcttatagccacttcccacccacgcatggcacttatgtcgcacacagtgatgtcaatccaattcagcctcggctcaatccgtgctcacagcaagcccagtcgctggttgaaacccacatcttgcacataccagatctacatccgcgcatgcaccgcattcggatcgatattttacaggttctcatggctgcaaaacgcgtctttttatgctacccgtgaagtgtctcagatttgatgatctcgcatgttaggatttaataatcgcgaggagccaaacagggggtagcttctgggttgatgttgatgcaaaaagtaaacaggaaaacagccgagcagccgaaaggaatttggcaacaggatctacaagtagccacgttacttctttcagcagacaagttgcaccttgtatcttcctctggcacacccctgcttcaaggtttgagacgaatctaagcgagcaacttttatgcactctgttgtaacttaatgggtttggcgacgtgacttttttaacgtgacccaagggtgaacctgtaacactggcacagaagaacgagtatggtgcaccgaacacaagagcaaacattacagtagtactgtacagtacttgtacgtactatttgttgttgtagacatgtgaaccccgccgagcagttcaaaggttagtagtgactccaccgaccttcgtgaagctacaagatatgaattactgtagaccataaaaccactgactgaatcagaaatgctgtaggtccgagaccacgatacgcacagcatattacatcctcaatcagatcattgcgcaatatcgataaattatcctctgaaccgttgaatactacgattatcgagtcaactgtaagacacatttacagtacttacagttgacagacacatcccaacacactggtactgtagacgaccatctaaattaatgcttaaattactgctatatggcgtgtcttcgttctgtctaccacccaaaaagccccgcagcagcagtcttcttgtgctctgtccctccactgttctttctcagatttagcggcttgagccctcccttctgagattgagaagagctctttcgggacgctgtcgggctacagacatctccatcttcaccattggcgctggtagaaacagacacatccgacttcagcgacatgcaatcttcggctgtagaagtggagggggccgcagagtttgctgcggaattggtctcaacgccatcaataccgagagaaacgttccgggcaggggctcctccgctggaaaccttccggccgcccttgaacaatgcagaagaccacaaattcgtgctcagtgggttgtaggaagacgtgctatcacgcgaatgaatactggcgttgtcgttggctccagacccaccgcctcgtcgctcgcctcgcttggctacacgcagagagtagtcttcaagggccgacccgggtccaccacggctggaaactcgtcgagaaaacgctccgaccttggcagcatcgatttttgtgctcttctgcacaccatcccggaaatcctcgtactccagtagccggttaagcattctctcgacgtacgaaacgagaccttcgttggtggcatacagagatcggtactcgagtcgcatcttggctagctccttgcgaatcttctcgtactcggtcacagagacagtcgactctgtgtaagcaggctcgtcttcgtcatcaccgatcttctcattagcctgattattgctctggtcaacaacacactcgttctcctcctcatcctcctcgctctcatcctcctccgctagagccatttccagctcgttgctaagacttagaccgccgttgatcatcttctcggccacaagcatctgcagcttttcgttttcctcgaccagtccgttgttgatctccttgagagatcgcatctcctcgtcgaaagcagtggccttggaagcaaagtccagtcctatctgctcggaagaagtctcaagcactgtgatggactgcttgagccgctcaacggtcttctgaagagccgtctcccgagcatgggccgcctgggccgcagcttctgcttccttcttggcagcttctgccatactggcctgagagttgcttgcattggcagactctcgctcctggtactcgccgagctccacatccttggccttgagtttcttgttgagatgtgagatggtctcctcgagttcgctctgcttgatgaacagctggtgcttctctgtaataaatagttgctgttcacccagcagactctcctcggcattgcgtcgatgttcacaagctcgcttgtactgctgttccaattcctctacccgcaagtctcgagctgtgatggttgcctcgttgtggacctgggcgtcctgtaacttttcgcatttggctcgaagctcgaccacctggcgctggatcctgtcgctttctgttcgctcaatctccagctgctcggccaaggcctgatatgacgtggaaggtagcgatgtgctgttccagccattggagcacaaggtgtacccctgaggcgagtagttgggagagtaagtctgcggcgagtgggtgcctgacgatttgcgagtgcccgagggtcgctttctgggaggtgtgttctcgttccccggggccgcggggatgttttgtggcaacgacattgtgttgtgtgcaccttagaatgaaacagatgagctgtcctgagtttggtctatggaatgagctccttgtagatgtcgtatgtggcctgaactcgtggtttattcggaggtgttgtgtaatggttgtgtatttgtcggatgaagctgaggcttagtgtcggtttctgtgacagagacctcagtcgtgctgcggtagtggaagaagtgtcctgcaagcggttgtggatgtgatgctgaatatgccagagaatgcagtctatgcagagattggcgaggtagggtagagtggagcacgggtctgtgaatgtgtggtggacttcccctctgtatcactggtgcgtttgcgtatgtgtgggtgtcgtgagtatgttccaatagtggtgtggagaaagtggtacaatagctggttgggtcacctttatctcagacactataatctacgacttacaaccaacacgcatgcacgcaccaaacagtctaagggaaggtccttgttggccaacgttaaggttctggcaactctatgtatggactggaatgttaatgcgcgtaggtggtttgggtatcgcagcgatgggggatgaatgacagagccgctttgcggccataattgtgtgcgtgcgcacaagctgccttgaaatatccattattctcatttctacgtcgcctgtggctctcgtgactactccgaacacccccttcatctccggtaatacgcccctgcaccttcctaatcctctgacctaccggccacaatggtcgtgaacggtggcactatgcataatgacatgacagggcaaatcgcaaaaaatattgggggtgtggacaatagaacacggagggctaatagcacaaaacagagagctatagaaacacacggcggggcccacagactgcttctgctacagctccagccactgagactctgtactgcccctacctatacagtgcacccctgtctggggggattgtgagacaccttgagaaacggttttccttgccactgtaggcgagcatcctctccgctcctaggcaaccgtcatatgcctgccagacccctaatcccaaaacagcaattgtaggtccattccaggccatctaaggcctcacgatatattattatttgtccaaacgaattttcgctgtatcatgtgtggagtctatcgaattatgaaacgagaaacgaacaacagggactggaaaaagtaacgccgagtctcatcatgggacgaaaaaagggtaaaaagccgcgatgagaacgaacacgaaaatggcatcctagaaaaataattgagcgctcagctgagcagcccatatataccgagagccgttgacaataacagcggcatttatatgtgcacctgtagtacggtaaccatggaaactgggcataacaagcacaccgtttccaaggcgacatggaaagcgattaggttacttgaagccttactgtgaaattagttcggggggatattacccatttaatgagatacagtaactccagaaaatgacacgagcagttaagagtataatgaaactacctcctcagaaaccgagaaaaaagaaattgcacacccagtggtagcaatatctcgttcttctgtacaagtaactcgtctcgtctagtccacgctcttaatacatgtctacctcatctaccaacgtgtacactggccaacacgtgccgaatctcgtatcagtttgagtctatgtatagcatataaccgagagacaatgggatctggcatatcaaaagaaaggctgtttattggtatcaaataacggacgtgtatacaatcaaaacaaacacaattctcgaccatccggttcgggcataaaaacaaacctgcgtgcacatgaaaagtccaactcctccgcgttcgacgtgtctgcatctcaacagtgtcgatcattgttattgtcaagccttgattgttgatgctgatccgatgggctagttcggttgacactcgaggcgctactcaatccgtacttgtaccacatgggacaaatcttgtctccggaagaggggtagagtagatagcttgaaccaatggagctactgtatgtgatgcactcaaatttctggcattgcgctcagttttcgcaccttttcggttggctacaaatgattctagaaccaacattggtgttctgttgatgttttcaaaaggctattgtgcatatggatggaggttgaggtgagacgtcttgtgcaagtaggcacgggtttgtggtcgaaatgaggaaatactattgacaattaagattggtaaaatcaattctgcaaattcgcaacatccttcgtctctccaatgtcgttatatccccttcacaatagtggccgaggctgagcacacgtgaataggttaaataacgttcaggtacttcatctccaatacgcattatggacaacaacaaaactgagattgcaagcagattaatctgcaatcagccaagctgacgtgttgtacaaaacagtcgggtgtgcgagagatctgttgtgatgtatatgacgtataacgaataataatgaccgcaatcttgatgtcgacggagtaactatagtgtagatgcgatggtcgtaaattgtggccaagggtcatggcgctccgtattaatataataaaacctcaaatgtgtccagaaaatgaagcgaccacaatgttacacattgaacccgcaccacgatccaacattccgtggtaactactcaatatagtgggctgcggtgtactaaaaagtccgatattggttcatattgacagctagtgtgcgattgcggggaaccaatggtacaatcaattatgtgaaaaatacattattagctgaccacgatggtgcaagtcaattggcttactactgtacttgtactgtaccaactggtgttcgtaagatctgagcctttctaatcatgaacaactcaatatattgaaggatcccccaggacgagctgattccgtctataccacaacagccttcaatcttggggtggcagctatcattactgtagtgcttacatggtaaaaacagttgattagggtgtattcttgaaatataatccattcatctcaagataatcgttcattgtctacgcctgtcattaggagcacacttgcagcactaacaactacaagtagctgatcaggtggtgggtagactctgtttaatatagtgtgctcagatggtggtttcgacagtttggagccgaaacgatgacataattcttttgactatgagtttttgaacttatcttcgctcaattaatatcccctggtgctttatagctttcttttcaccatatcattgtttaataacacaaatatgcaaggtcaagaatcgaactccgatgccttttctaattcaacttaatgtgaattaacatacccaagtaaatagcacacccactgagatcaaagttcaagcttacagtacagtacttcatggctgctgcaatcctgatcctttcaatatctcaccatgtccgccccaatcccccagcagctgcttcaacagcctcctcccatgctccgtaatccccatcttgagtcccagcgagcgcctcaatcttctcagattccccaaactcctcaacagtccccgagaaccctccatgaccctccccagcaagccaccgacttctgggtcctcagcagcaatctggctgccaatgctctctactgcgctgccttccctcttcttacaggtctctatgctgctcggggtctgtctgatgagcctgtcaagcctgccaagtgggagaccaagctcataaagttcttcaacactgatgtcgagaagctgaacgaatgctactcgcccctggtggccctgggattccccttcttcgccgcatattccaacagtatggggattctgtcgattctgtggtccaactggatcggtctcattcagattggcgatgaccagcacatgcttagtttgctccagggggcagagcagatcaccaagggcttctcgtggctcgctggattcctcagtttgggcactcttggaatctggacctaccgaagacaacagcgacgatccgcacaggcccccggcaagtcccgattgtggctcatcggtgcccctgaggtctctcttgccttcgtcagtctcgtattctaccctctcgttgccactcctatttattgtgtataagacgtgagcaacaaggaccttagctggacgtgcacaaccacactatccgcaggtgcttagcccaagcataaaacaatgaaatctattgaaattacttctacgattctcaagccgtagctacaagtacaagtacttctacatcaattattgtacaagtatgtcctcatgaatagagggagcaagacattgattgcaacgccactgaaagccctgaagataccggcacattcagcgccctatacactggctcatatttactgtacaagtacaatacaagatacaatagtatgtacatacactacttttacttgtattcgtcatatcccttcaattttttctatcacatacagtatgtacatgtttccacatttctgtgcatttcgcgcaataccctcttcactgaaatcttcaagaatacaacatcatcatatacatttatatatccatcaaccagcattccttagacaacaatgaccttcttgccagtggccttggcaaggagccaagaggagaatcgttcgatacgaccgggcaggagctggaaatgctcatgaacatggtcagcaacattgtcggcaaggtcgacgagcttgtatttggtggaaacaagaaacttgttgataccatcatgggccttgatccaaatgttgggatcggctcctcgggtgaagagacccaggttctttcgggccttggcgaggagctcgtttcgtgtagagccctggtaggtggggataccgtaggtgtcaaggtaagccttaaggtcagaatcggaccactcagagaaagaggtcttcttggcctccttgtactgcttgtcgaggtcagcagagagaacgtcgtacttctcaccaagaacgtgctgggcctgattgatgtacttagaagcctccttaacgagctggtcgtgggagcccttggcggcctgtccctgctcagagagccaattctcaagcttcttggtgtcccaagactcgaaaagggagtcccattgagagccagcagcatttcggtatcggttcacaagcttgagaagatcgtccttggtggcaccctcgggagcctcaacctttcgagactccaggaaagagcccagtcgggattcggaccagagcttggaggcctcctggaaggcctggtcagcaaggtcctcggctcgcttgacgaacggaacatgattcttcttcttgtaagtggttttggcatcctcgtagtcgttgtagaggagctgtcggtttcgtcggacgatggccaggacctcatccttctgagagttctggggaacagggattccgtgggagtcagcccagtacttgagctcggagttggaccagtcgtcgaagacgttctcccgaatcttgccagccttgtcgaagacatcctccttggagatgtcgaaggtcttcttgaggttatctcgagcttgctcacccttaacgtaaagggttcgggaattctttcggacggcagcaatcagctcgtttcgcttggagccctgggggacaggaattcctcgctcgtcgagccacttcttgagatcagaatcggaccaggcgttgtagagccagttggcggggtaagaaggcttgggagaagcaccggtgacaccagcggcttcggcaatcttctggtagttcttcttgacatccttgatgagctcacttcgggtagcagtagagggaacaacaatcttggcagactcgagcaggtcgttgagctgcttgttggaccaggagttgaaggtccaggtccagaggttaacatcgttgtagatgttatcggccagcttggaggacttggcccaggcagcggaccaggtctcgtcggcctggttcttgaggttgccgagagacttcttccagttggaggagagctgctcgacgtcgatgccgagcttcttggaaagatcggtggtggaggtctggtcaaggggagaggtgaggtcgttccagtggattcggacctccttaaggagagcgtctcggttgctcttttcgggcacggtcacgccattgtcttccagcagcgatcggagatcctgagaagaccaggtgctgacctggttgtgactgcttctgttaggagaggacaccagcaagatgccgatgaatagggtgatagcggagagcaaaattcgaggagctaccgccattgtgaaataatcaatcagttagttactgtacgggaaagagtgaaacctcagtggcacctgccgccttaaatataacggctcgtttctgcacgcagtagcaacccaaagtgcgtttcgtattaagttggtgctaggttgtagtggatgattctgagagagcggacaagtgaaagcaatggagtgctttttttgccaatactgaaccttctcaaactgtcgacgagtcgctttcggtgcaattgatatatctacttcacggtggagctatggtcatgacattgcggctggagggtccttctcaagagacttttcttggtgcctccaacagtgcacgtgcatgcgggctagatgaggtgaatggagtggttcaaagtcgatgttcctgacggactagaggcgcccaaatcgaaatatcagttcaattgcacgtttaaaattgatttttcaagtttcaagggccaattcccactcattcatcacttttatcagcctcccacatgtggcttgcctcacctcaaccacacttgctactatcaagctacattgagtttaggtgtggagtttaactatgtgtcaatgacttcgttttacatacgtgacgaaggacccagcaacacgtaattgcggcgctagcttggatgaaggaaagacctcaattgatttatccagtctctggggtgcaatacatgctgttaagccctccccgcaaactgcttctctgtacatctacgctgcagatgtatgcagtccatgacgccatccaccgctggcttacaactcgtttgccaccaactgcatgtgaaacgagtccgtggtttgcgcagtttgtccagggctgaccccacaaacggagaaccaacccaacatctggtggactgattgggaaccgtacgtacaaaaggaaggttgaggagcatgtgatattatgaggggtacacagtacgtggcaaggatacaaggatagagtgactgacacgatttctacattgtccaagcacacttattttctacaatacgattcaggcccctcatatactccgcagtgattctttggatgcttgcttttggacgtactaactccgcttacccaaagtgccatagccttcaagtagtgcatatataatggagtcgaagaataggaagatgttgctcacttgtacagtaccagatgtgggccagtgaatggatcattgaggatattttatgtctccttctaaagaatatgctcacactccaataaattatcaactatggttggtgtacggctccatgcctgctatagtacgcactgcccgtagctagaggacttcgattgctataattgctttaaatgtggttggggcaagtttcgaaccgctgtgtctgatttatgtgaattcaattcgcatgtacgtaggtgataaaacccggtgcttttgtagctatgattcagcagaaaaatgattcggaattaattgacggttctgtgttttcatctgggctcaattctgaaggtttcatcactgatgatcttttgttcagattatcaactgtttacttagtaaccgaagcgtgtttctcaacaaaaaaacccactcattattaaccagaaatggagataaaaagcaattaatctcatactacgatgtccttccattcaaaacagcaattttctgatccacttcgagattcggaatgcttttatatatgacatcttcactaccaccactgggtgactaatctggaaccttaacgaaaatataaactctcagactcgctggtgaaaaattcaaaagcctcgacagtgctacacatccaccacagataaaaatgtcagcttttggattccccggcggcggagctcccactcctccccaaggctctttttgggatatgactcccgagcagcagggaatgtactcggccaacctcatcatgggcaccatgcagtcgtgtcccggaaagtccgtcatggctggtgtcaccggtttcggactcggtggtgttttcggtcttttcatggcttctgtgagtatcaacgtgtggggataaggtggattttgagtggtaacatgatcggtcaggatttggggtcagtttgaagtcaagtagactatcaaatgtggagactggatcacacatgttgagtgctttggtgtttcatatatgcccttgagacgctctgagtacactccaagcgtgttatagagtccatcgagtctctatctcaagtaaatctctgctactttcaacgaatactaactaagatggcttatgatgcccccgttggaatgggtgtgcagacaatgtccgatctgcccttcaagcagcagatgaaaatccagttcaccgacatgggtaagcgagcatggagcagtgccaagaacttcggtttcattggaggtgtcttctctggaaccgagtgttgtatcgagtctctgcgagccaaaaacgatatttggaatggtgtggctgccggatgtctaactggtggaggcctggccgtcaaggctggcccccaggccgctcttgttggctgtgccggtttcgccgccttttctgcagccatcgatgtctacatgagatccgataacaaggctcctccttccactgatgaagatctttaatttattgtacatagtctaaatgtgagaagtaactgctcttactgctaagagtgtaggctaaagagaaactgggcctgaaactgccagcagatggtcgcgggggatcaactggacttatatgagtatgtactgtaggctatgattctgagacagatctacaggtacagacttgagactcaagcagctgctttttcagaacatcgaagcttgaattctgcctgtgattagaagttccaatgtaaaaatcatattacaatatgtacatactgtacaagcactctcagttcattcctataactctctgatgcggctaaaaactcccttctctgagacatcagctaatgaaaagggttgcggtctatgagaagtccccagcggcaaattatgagtgagtaattcggaatgatacaattctaattgagcttggtagagctctattggtattggaatcaaacaacggagactactacccgacccccacaccctacaggttcaacttgctcacttctactgtttatacttttaagagtttcattattttcaacctgaaccaatgatcacacgttctacaccgaaggagaaaagacatttacaatacggacgcattcatgacactcataactgttcttaaaccattttcttattatcccaccctcctcccccattcctcttcatgcctcggtttgtgacccgttgaatctccgatgcatgagacatgtatgatagtgggcagatatattgagagggtatagacgagattattggccagaaagtcttggcaacgctcggataatgctagttacgggtatttaatccggtttgtcttcagtcttttctcttctcttcacatttcatcccgtcataccatgtctctcagaaacaccaccgctctgatcactggaggatccggaggtattggatacagaatttcaaaggcctttgccagcgcaggagctcgagttatcatcctgtctcacaagaaagaagaaattgatactgctctgttcgctttacctgaacgacttgagggagagaagcatcatgaaggcattgtccacaacgtcacctcggaacaacctcctgctggagtagacttctctgaagtagatgttcttgtcaactgtgccggcatttctctcaccggtctactctcaaccacatcaactaaagatatacaaaatgttgtcaacgtcaatctagtgggaaccatgttcatgaccaagttcgccatggaagcctggcagaaaagataccctgaaagagctgcttcagatagaaaggcggaaggaaatggctgtatcattaacatttcttccattctcggacttagagccgtctctcctggtttgtctatctacgcagctacaaagactgctcttatcatgttcaccaagagcatgtgtgtggagggagggagaatggctatcagatccaacgctatttgtccaggatacgtcagaactgaaatgaccaaggctcatgaactgtctttcaagactcctctccaggagtttggagacactggagatgtgtcagtagagagcattgccaatgctgccatgtatttcgctaccaatcctcaggttagtggctcaatcctcagtgttgacaagggaatttgcgccaactgaagtaatccgtttaattatatatataatgaatgtttatgatccagtgttggatcggctcgcgtatcatccgctcagcacccaactaaaatctaactaaaaccctagtaccccagactataccctaacctcaataaacttgtactgtctagctgagtcatcaaccatgcatcctcccaacacgcacaataattcgacacacccaaatcacatcaccacactctaattatcgtcaagttcagacgacggttcagacatcaccaatgtacaacgataacatgccccgtcgctcgacgcgttcgtcgctagcaggatcccctggtcaggtctcgggataccaaggaggctctccttacgttgatggaggtatgcctgggggtaaccacggtggaatggtcccgcatcagggatcgaacccctacgagtttgtgccggtgcctccgggtcctctgcctgttccagtgatgactccgactgtcaacccgcccatgttccctgtcaaaaggcccacgccaacctcaatcgccaaggccaacgcttttggagtcggccactttggcattgatttcctcacacgtatcaccttttcgctacgatcaggtatcgactcggaagtcgactgggctctcacagcactcgtccaagcaaccttcaacgcccctgaccagttcaaattccgactaaatgagtctctcatcgccgacctgctgggccgtgttctcaaggcccggtttttgacccacaaggagtccgccgacggagaacacgtcggagacacggacgcagatgatcgagtgcatcaaagtgtgctagatatcatgctcattctgagaaacgccgctctggaccccgaaaatgcccagtttctggctactagtgacaagggtcttgaggtggtgctcaaatgtttgcaggtctcgccctcctccctcacatccgaggtgctcagctatgccgttgacatctgcgagtctatctcgttctatgtgtctccttcctcttacgacgaccctcttctccaggctgtggctcatctgttggagacctcgtctgaccgagctatcataatctctaccactcgagcactcacccgaatgctggtccatgagtatcacgcccacccagaagcagagaccgagccgaaggaggacgccttccctatcattactctgttggctcgacgatggcatcagatcgtcgacaagactgtgcagatgctgctggttgaggctgacgaagagctcataattgctgctctcgatttcctctatcagatcactcgtcgaggtgcatttgtcactcgtctgttagaaaacaattcgaacgctgagattctgtcgactcacctggcccgtctgttacggttcgagtttccccacgaaaagttcattgactacatccgacttcccccacgggctactccgggccctgtaaagaagaatgtccctacggtcgactcgccggccccacgtcttcctgaggatgttctgaacaaccttctgacgatgcctgagccccatcgagccaatgcatggatgcgagcttcatacgaggagactagcggaggtgaggtgacccagatttctctgtggaagtcgtacgagtcgcaatttgagccctactgtaaggagggctctgctcccggcgtgcacagactgctcccggccgtggagtttatcaaaaatgtcaacgcggccttcactcgaagtgccgccatggttgtcagtctcaacgatggaaccaaaaagttcattatcaagggtattcaaccccgaaaggaacccgtggaccctgctaccatcgatgcacagaagcgcgcggagtttgaacaccgtcgaaagatggaggccagatatgccgagtacgatcaggctcgacgatacagactggacaacaagagtggagtgtctccggccgctattctggtcatgactaacattgccaagagcgatctgggcaaactggcactgactcatgtggttgacaaggtggtgtatgctggtactgtcaacccacacattgcccagtacatgttccccttattgggcgagttggagaatgtgaagcccgaggcatagatgggtacaatataaccaggaattaatgtatttgtatttgtatgatccaggaagcatgggacagctcatgttcagttcgtgtgatgtaatgtaaccccaacccttaactttctaactatgcgagtgaccatgcatcagcgacatagacgtcatcatcatcacctttacattcgcaatcgtcattctttacaatgggtaacttttttgtggatttatgggagtccatttttacccccggcactactccgaccctggtcaaggccacccacggctcgtttgtgctgttgatcctatctctgcttttcctcatctggaacgctctgaacatccacaccgtgatgctgctcatcattgcgctgtgtttgtggggcactttgacctggttcatttccgaagtcgccaaactcaagaaggagggtaagctcaagaccgacaaggagctgaaggaagaggccgaggccaaggagtccaagaaggagcaataaggagctacgggaaaaaataatgtcgtcgctagacctgccatgagagaaagtgtcgccttgcacatgatacagtagtgtgtgcttcaaggtatcttgttgatacattagaagatacaccttacgagcgcgcatgcttagaaacacaactaaatttcgtttggaggacatgctgtgtctcctttggggagaatggatatatattcaagtattgtatttgtaatgaactgatatatgttggtttgtgttctgaagagaggcacttaagactctacacatacttacttgtaatacttgtactatagcaacttgtgccagagcatgtccaatcactataaataagaatagaatacctatatccgatgatgcaaaactgttaaacaaaaggtgtgtagctcgtcactcaagacatccaagctggatcactggaaccgatctatcttcatcaaggtcctggacgccaccagcaccgttgactgtgtgatacaacgctgacgctctaccaagttcgctccatgattgtttgtgaagagagtcctttggtgacttgaatccccatcgcgtaccgggcacacacttgacaatgacgtgagagccctttatttgggttgagcgttggcagccttcttcttcttcttctcctcgtcctccttgttcttcttttcgatttctcgtcggttgcccttgagaatctccagatggcccactcgagaggccagcagcttttccgtggtggcggtcagagctgcttgatgcttcttcgcaatctcgacgtctctttgagcgctctttcgtcggggagcaatctttcggggagcggccctcttgggagcaatcttgccagtgggcttcttgaccttgctggtcttttctctctttttgagacctgcttggggcatgttttgatggtgctatggttgatgtagattgtatggttatgatgttgggatagccatcaatatttttttgtcgtgcatggggggcgcctcaatagggttaggggaaggggaatctgtgattaagatcgttggggggctatgggcatacaggggaatttattgcgtatctgagatgttaggattatgaaaatgtcgtcagattttcctttctcagtcgcctgaatcgacaaatcaaggttgtgaagtttttgcgtccacagtgttaaacttatcgtgtctgatcaagtttttttattctgcataggcgtcaaaaaataacgaatgggatactggggaacaaccagtgatttgacttataacatcagttgctagagaagaccaagtactatttgtgatcaattcgcctccaggttacagcctctacctgtcacgcaatatgttcgaagtacgctcccgcagaccgggtagttcgagatgcaagcttattgtacaatatatacaagtagaagtatcgtgcttgtacacctactcgtgcgatagtcagaatcatgactctccgacaatacatattgtacgatggcataccccaacttgttgcacccgaaagacctgtttcagacccttgtctcaatgcttggacatgccgatacatttagtcacttcaaataatggcaagttttgcgtgacacatttcccgccagtgattattacgccgaccgatagccgcgcgtggaaaatcggcaaataaaaagatttttttccgatttcaaagtggaccgaacggctcaaagtctgctggcgagactgcaaaactcacagctcacagggtccacgagtcaggcacatgttaccctatgtaaacagggtttgctgattaagagcttgccacaacgtagagaaacaggagtggatcactacaaaccaagtgtgtggtaaccaaaataataaaagggcgtcttacaatcttgtatcagccaatcaagcgtccataattagctgacgtcgacatcgacccactgctgtacaattctccgtactgtagttaccatacggaaactgaagcataagatatgacccacgaacatcagtataaatctccatgctctagccgtgcctttacgctgtactcgtatgagtactacacgcactagggatactcaggtcctgccaacctccatcgccacgcttgcaattgcagcagcggcgtgcaccgagtgtggcctgggcttgtcgctttggctctgctcctcagacgttgcgcctatgccatgccatgcttcttgtctactcagtccccctcgtttgcctctcacaggcagtctctgagtcacgtcttgtggggagaggaggatgtgtggtgaggaggcttggggcgtgtagtgggcaacggttggccgtggctgagaatgccagggaagaagaatgacggaaataacaacgtaaaaaaaaaaaaaggacgaaatatgctaccaagagaaagaagcacctggtgacactctctccagcagctcctaacgtctttgtcacttttgctcaatctcaaaagctgctccatgaactatgaagcttaacatcataggctcttgaggatgtgccaaatattatcaaagggtccgggaataagcggatagagggggtggttggttgttaaatattacgtaattggatttttcaccctccaatctcttcgatctgccccttggagctcacatcttccattctcttacacctcttaatccccttcatccaactcactcacactgtcttcagctaacttcagaaccctatctgaccgataaaaaaaatgtcccaaaaatttagaccttattatattactataggcctgtctcccttttcttacccaagtgtactcaccctccaaaacccaacccgcccaaaccatgctcacgctggctggaccccaggcctattctcagttccgagtgaattctctgctcgagaacatcaacaaggccgtcaattcgtccgccgtggctgccattcgagccatctacgttcattacgttgacactggagatgcagctctgaccgagaccgagtccaagctgctcgactctctgctggactacgaccagaaggccgacgctggagatgctctgactgccgccctcatcaaggcagccgtcaatgacgaggctgagctcccgaccgactcgtacctgcttcgaatcatcccccgacccggcaccatctcgccttggtcctccaaggccaccaacatcacccagaactgcggtctgccccacgtcaagcgagttgagcgaggtctggctgtgctaatccaagtccgtaagggcttccctctgggtccccacgttgaatccggcgctttccttgatttcatttacgatcgaatgacagaggctatccgaatcggcgcccccgtcaccgagaaggacctcttcgcacaccacgagcccaagcctctcgtttccgtgcctcgtgctggtatcgctgaggccaacaagtctctgggactcgccctggaccagcccgaaatcgactacctgcagaccgctttccctcagcgagaccccaccgatgtggagctgttcatgttcgctcaggtcaactcggagcactgccgacacaagatcttcaatgccgactggaagattgacggcgagaacatgcctcactcgctgttcaagatgatccgaacaacccacgagaagaaccccggctacaccgtctctgcttactctgacaacgccgctgtcctcgaggccgctggatctggcttctactacgctcctgatcctaagacccaggtctacactcttaagcccgagcccgtccagtttctcgccaaggtcgagacccataaccaccctactgccgtctctccctttgctggagctgccactgggtctggaggagagatccgagacgagggtgccgtcggccgaggctccaagcccaaggccggtctttctggctactctgtttccgatctgctcatccctgacttcaagcagccttgggaacaggacattggcaagccccaccacatttcttctgcctatgacatcatgatggacgctcccattggatctgctgccttcaacaacgagtttggccggccctgtatctctggatacttccgaaccctcactaccactgttaccaatcacgctggaaagcaggagattcgaggtttccataagcccatcatgattgccggcggtgtcggtaccgtgcgaccccagtttgcgctcaagaacaagcccatcacccctggcgccgccctgattgttctcggaggaccttctatgctcattggtctcggaggaggagccgcctcttctgtcgcttctggagaaggatctgtggatctcgattttgcttccgttcagcgaggtaaccccgagatgcagcgacgagctcagatggtcattgatgcctgtgttgctctcggcgacgccaaccccatccagtctatccatgacgttggtgctggaggtctgtccaacgccctgaccgagctggtccacgacaacggcctcggtgccaagtttgagctccgagatgtacctaacgccgagcccggcatgtcccccatggagatctggtgctgtgaggcccaggagagatatgtgctgggagtggctgctgccgatctcgataccttcaaggccctctgtgaccgagagcgagctccttacggagttgtgggtgtggccacctccgagcagcgactggttctgtccgacaagttgctcggttccacccccatcgacatggatatgtctgttctgttcggtaagccccccaagatgtcccgagtggctgctaccaagcccttgcgactccagcctctggaccttgcacccattgcctcctttggcgaggctcttgaccgaactcttcacctgccctctgttggctccaaggctttcctcatcaccattggtgatcgatccgtcaccggcctgattgctcgagaccagatggtgggcccctggcaggttcctgtggccgatgtggctgtcaccatcacctcatatggcggtgtcaagaccggagaggcctttgctatgggcgagaagcccactctggctcttatttctcctgctgcctccgccaaaatgtgtgttgccgagtctctgctcaacctggtggcctccgacactgttctcgaccgagttcgtctgtctgccaactggatgtctgctgcttctcatgacggtgagggttctgctctctacgaagctgtccaggccattgctctcgacctgtgcccctctctggacattgccgtgcctgtcggtaaggattccatgtctatgaagatgaagtgggacgacaccgaggttgttggtcctctgtccctcgtcatcactgccttcggccccgtcatggacgtttccaagacctggacccctcagctcgaacgggaggaggcctcttctctggttcttgtctctctgtctgccttcgagcgacttggtggatctgctctgtctcaggtctactctcagcttggcaacgaggctcccaacgtggacaacaactctgttctgaagggcttcctaactgctgtttccgagctgcaccagaagaaggacgacattgttctggcttaccacgatcgatccgacggtggtcttattgtcactgctctggaaatggcctttgctggccgatgcggtgtctctcttgatgtcactggtaaagatgctctttctgcttacttcaacgaggagctgggtgctgtcttccaggtggctgactccaacattgccgagtttacttccatcatgaccaagaatggcgtccctgcttcccaggtcaaggtggtaggcaagcccataatctcctccaaggagcagactgtcgacgtcaagttcaacggccagcccgtctactcgtccaatcgagctgctcttcaaaaggcttgggccgagacctcatacaagatgcagcgtctgcgggacaaccccaagactgctgacgaggaatacagcaacattgccgacaacgccgaccccggtattgttttcaagctgtcatttgaccccacagagtcaatccctcagtctctggtctctcagaagcctaaggttgccatcctccgagagcagggtgtcaattctcacatggagatggcctactgtttcgagcgagccggcttcactcccgtcgatgtccatatgtccgacctctcgtcgaaacgtcagcagctccccgacttcgttggtttcgttgcctgtggaggtttctcctacggtgatgttctcggtgccggagctggatgggcgaagtctgtacttttctcgcccgagctcaagtccgagttcaccaacttctttgagcgagccgacacctttgctcttggtatctgcaacggttgccagttcctgtctcgactccaggagataattcccggagctgacaactggcccacctttgagcgaaatgcctccgagcagtacgaaggccgaaccaccatggtcgagattgtcgatgaggccaaggagccctgtattttccttggcggtatgcgaggttctcgattccccgttgccgttgcccatggtgagggccgagcctcttttgcctccgaggacaagcaagccaagtttgcttcccagcatctggctgctgttcggtacgtcgacaactacggccacgccactgagcggtaccccttcaaccccaacggctctactaacgccattgctggtgtccgaactcccaatggtcgagttctggcgatgatgccccatcccgagcgagtgtctctggttgacgccaattcttatcgacccaaggatctggctgagtctccctggatctcgcttttcaagaacgctcgaaagtgggtcaactagactcatttttggagaactaatgttataaaaatgtattgaatgattgtattgctgtataaataggaaggcgattacataatgttcatgtcgtattcaagctcccgctacgccctgacctgaagcgcttcgggtgacatacgattacggataatgagcactatctgggccgaagtagccaattttgggaatggggagtctagctggaggtccattgttgtctgccccggcattagacacggtgttgccccaccatttgagctcgtgcttcacatactcgaccgagaagaagataatgatggcagacaaagcaataccagtgtccatgcccgctgagaagacataggcgtactttctccaccagttcatgaaccggttcttcagatagtagttgaagaagatggcaatgtaaatgcccgtagttttgtaagagaggttgtaaggagcccagtcgatgcaaccatggcagaagagaatggggttgaacatcaatgcttttcgcttgaagttttcgatctggacagttttgtgggggtacttcttcatcatcaggttggggataagctcttgggcggcgtagaacacaagggcgagaactgtaccaagcagaaacatccacttaagaattgggtactggtggtcaaacatcttcttggggccaatgataccccacgccaccgaggcactgaagaaagtggtgtctccggggcaagtgaatcgatccttgttcttggggtcacagagatcgtcgatactggtgatctggaactttaccacacccatgcagattagaccgttgactaaagtggcccacaattgcagccagaagatagaacgagggggcagatgagcatagtgagtcagcttctggtcgttagcgtaatgctgggcctgtgtggaaatttgcacacccatagccttgacaaagttgagagccatgaactgaccaggaagagcgtatccaatgatcagctcggagagatagttgagcgacatttgcacgccagagtatccctggatgatagtcagaggcagcaggaagataccaactaggccaatgataaacaccaaagtccagacaggggtttgcatgggccaatgttcaaccagagcgatagacagaccgaacataatgatgaggatgagatagaaccaccagtcggggacttcggggtattgtctcattcttcgggagaagggatcatctcgaccttcgtaattggatcgtgtaatgtgtcttattgactttaccatttccataagggcgtccttcatgatatcccagtccatcaaaactgtgtaaagaaacatgagagggtacacacagaatgaggatccgtaagagacgaggtttccagcagagtagtagggaggggagtattctctgtactttttgtcatcaaacttgtagtcggtgagaattctcttgacgtcgtaagattttcctttgttgtcaaacaatcgattggagttaatggggatgtatccagtccagttattgttggtgtagtagattgccagaataatgaggccagaaatgagactggcaatgtatgtgttgagattggagaacaggggtgtgaagacaggctgaaatcgtgacactgcaacgttccagtcaaacgaagagatgggattgtaaccaagaccaccaatagatcccgtaaccacggccagatccagattcttgggtgcaatccaggtcatccagttaaaagtgctgaagaacttcattaggtaatcaggaacccaaaagtagagaaacgagaagagaaatactgccaggaagaaagtgtatcgcgaaactttccatccgtcgacgatctcctttcgtctgggagccagaagagccctgttgacagccagagtaggcagtagagtgggccacatagctttaacagggtacacagccactcgcttcatgagtccaccaaatccaaagccgagcatctgagtcactaacatcagcagaaacatgtatccataatcgttagcccaaggctggttataaaatcgtggaaggtactggacaagaacgttggaggtaacataaggagttccagaagcacaagagaccatgattgttgctagaagttgttctttttgtgaccaaacaccgggattgagagttagtctcctccccctcactttgaatccccagtcaggcaaacagtattgcaagagtcgcccagaagggtacaatagaagttggcagactgacactgtaagggtgatatgaggcattctcagactgaaaaactggtttacgaaggctgaaatgcctacccaaatggtgccaatgacccacactctccacgtctctgtagtgcattcggtatcatcatatgggtcggtgactgatctgacctcgggatatggggaccaccagtggaataaggtggcccagtatcgtaagagttttacatcttcgttttcgcttgtggggtctttttcaggatcagccttttcatcactcccagtctcttcatggctgtgctcttcggactcgtgtggctggttggctcccccaacaacagcaacaaggtgcgtaagcaggacgcgatcgtgatccgaaaagttgtggtcgttgctgtggtactttaggttcttccgaacaatgtcgatggcttcggcctccgtcatttcctggaacttttcagccatgaaatgaacctccaaagggtagtctccagtatcttcactgggaggaatacccagctggtaggcgatccagccgagaacgtccggagactcgtgaatgctcggatcaatgttgaaggaatcttttgatgacatgatcctacttgtagatagtttcttgctccccagcttcgaggagccgaaataaataccttcccatttaactcgagtaggtgcatatcgtgcctcgccttcctaagattaaagtcgcctaatcagccacagcatcgagagttttccggcggtagattagaacatgttttcgtataagccacagtgattgtgcatatttggtttttgtgccggcttgttgtgctttccgtgaagtcttcaaatctgtgccaagttgattgtgtctcgtttactccttatcaaggcttggcacggctcaatgacgcaatcatcaaagttcgcgatggtcagtgtacacaaagaagactaccggcaggcgaagagatgtagaaaccaaatatcggctagagttacggggaaataaatactccttgtagctacaaagcttgatcgaccggagtgtggcggcgttatttgggaaccgatcggacattcggagtataggaagtttgatctgatttcataactacaagtacagtagtcttggggagcagttttcagtgtgctcaaccccgcagcggctgtgctctgtggcaccgtcttgctgaaacgtcgcacttgaagctatgtacagtagaacatacgatacctacaattgtagtgtgccatgtgtacgatacatggcgtgctcgccactttacaggaggaaagctcattatccgaatgcaaccgcttgtacaaaacctgcatcattgcaaaccctcggcaagtggaacggcacgaagaaccgatttgtgttcgtagcacaactgtggctggctattagactcgtgaacctcgagaaagagtgtcgagactaatgcgtttggattatgcgttggcagctgtgtctggacaatgcaacttggcctatccagaatcacaagagtgtctcgcccagaacgaaatggttaactactcggtggtataaatggcatcatattatttcttctcatgtctgagataaattatttccaggattatagcatttgatcaccaaacaagcttgtaatttagcgtcgaagagagcaccacctgcccatgctaacagttttccgctcgagacaaaccgattgttccttcgtatttagtcatttcgggaagttgcttacgctgttatatgaaagcttagtcgggtcagaattgctcttgtgaaagacaccacagactataagtacatactgctcttgcagtgcggggcatgaagctatttttgtaagtcttcaaatcatttcaccaggcgttttccctttttttttgacatgggtagaggaaacgctccttggtgcacggtatgtaccatgttgtctgtacgttagttcacagtgagcgaaataatgttgacgtaatggaggctgcaaatgacatccaggtagtgttcgtgcgacattcatcggtatatatggtacagtggttgtgtgtgtgtgtatctgtcattgccctggtctcgctccacatatcattttttgaattactacatatgtacaggtacaggtagggttccctcagcactttcagcgatgtttcttgattcaatcgaatcattgtaactgtaagtaaacctcgactaatagacccagaggatactatgcagattactgtatggcatttcctgtggtgactataaaaagtgacttagtttgctccaataagctaattattgttccagaaacaacgcttgccactgctacgaacctcgtttcctcacgaagaatgacttcttccatgactattcgttgcttatagcaccaccacagacaacactacatactgtatttagaatgcactggcgttggaacgggtacctattcctcacccaggggcctatcgagagctaacgtctcgtttttgacatttctcctctagcatcaccgacaatgtgccatcatacttgcgtttttccattcacctgtatcatcctcgacattcacggatccctccagtttgcctcccattgcataaccgaaccacttgaaaacaaagaacacgcatcttcttgtaccggtacgagtacgagtactgtacccttgtctctctctctgcttgtactcgcgtttctctgtcacgtgacgtccctttctcatgccgaaccctgaagggcacggctgtgggggagatgcatggagcacgcgagcacaccattttgtaaacgagtcaggtgggtatcagcgcgttgtttgtgcagctgcgatggtatgcacatttgtgtgggctgttgttggctcatttacgaggcagcatccgtccgaatggaggttcctctttcaggtgtttggcggcctctcacccttcgaacatgacaaagttttctttttcggtgtggtcaggtaattttttagcttgctttttgggttggtgttagttttctcctttggcttctgacgggtatcaacaggaaccacagcttctacgggaagatttctcaaaccttgatgggtaaaactaggcaaccaggcacacatgttgcaggaggggtctgctgtggaggggaaggggggtaagacttcagggtaagcggaaatgagatctgtagtgtcccctgtaatacacatgtccaattttaaacatgggaatacccatgtatgaactgttataggggccattggttaccaatttccactctttttcactttgctttttgccagtgcagcactcatgcttgtcccagttgccagccaatggataagtagctagttatcggtggaaatcgctactctacatttgagattaaaacctggggctgaatgaattttgagaaacgaggtgttcgtatagcttggggtactatttcaaccactctaatgctcactttctccactataaccacccatacaacctcctgtcttggctatggtctgcactctccaaaatcgtttgttgtgtgtttatcattcaggtatgcataaggttctgagacctcaggggatcaggaggactgatttcttcgtgacaagtgattcacggtcagaacgcggtgagtgaaagatattacatcgccctcaaacctccgatagccttccgcgatctcgggaaagtcacctgccaactgctacactaaaccaacgttttccactcttttaacacctccctcaagaagcacagctcctccatcatgtcatacggaactgccccaatcgactatccaccagaccgtcagagacggtcgtcgattctcataccgtccatcccctcgtctcccttcaccggtgtgaattctctcggccgatttgcttcgtcttttcagcgagctcagtcctttctgaatctggatccaccccagggtcttaaccgagaacgcacctactttgacgatgacgaattctcgccttacagacgaggtgaccacacgggagacgatgagtctgtgtttgacgagtctgacttcctcgatgaaccctcttttgcctacaccgaatctgttcagcccagatcgcgattagactcactggtatctcaagatgcgcctctgcttgtcaagcgagtggaaaatgcagatggtactattgtcacatccgtcgagggacagtctactgccccccagaccgtcttcaactctgtcaacgtgcttattggcgttggtctcctgtctctacctcttggtttcaaatacgccggatggggtatcggaatggttttgcttctggcatctgcatattccacacactacaccgccaaacttctggcgaaatgcatggatacggatccttctctggtcacctacgcagatatcggttacgctgcctttggatccaaggctagagtgctcgtctcgcttctcttctctcttgaactggtggctgcatgtgtttccctggtggttttgtttgcagattcactcaacgccctggtgccacaagtgaccaaaacagaatggaaggttgttgcgttcttcgtccttacacctcccactttcctgcctctgtcagttctctccatttcgtcgatcatgggaatcatgtcggtcgtgggtctggtggtgattgtattcattgacggactcgtcaagcctactgcccccggctccctccttgaccctatgcctaccagcatgttccctcatgcctggatcctcgtgccgctgtcgttcggtatcttcatggctccctggggaggtcatgctgtctttcctaatatctacagagacatgcgacacccccaaaagtacacaaagtgtctgaagaccacctaccgaatcactttgggtctggatctggccatgggtgtgcttggttttcttatgttcggtgatcagatccaagatgaggtgaccaagaacattctcactacggaaggataccccgcagtgctcaatgtcatcgttactgttctcattgctcttatccctctgtccaaaacccctctaaacgcccgacccatcatttccactctcgatgctctctttaacatccaagccagccaaacccctggagctaagattgcccgagtttccacacgctgcatctgtgtggctacttttgtcattctgtccatggtgttcccttcctttgacaagatcattgctctcatgggatctggcttctgtgtctccatttgtctcattctgccgctcagtttctacctcaagattttccgacacgatatcaaggggggcgagcgattcttcatctacgcactactgctcatctattcggcagtagcggtggttggtaccatttggtcgttcctgggtgtcgagcctcctcatgtatagtttgaactacaataagtactcgtataccacaattttgcatataattaatataatatatatattacaagtacacagtacgatctaggcctcatcaactctcacataatagtgagcttgtgctggcttatgaaatagtatttactaccatctctactaagttagtactcctattccttataattacatcataaacacagtcgtgcatcctcttatcaagttacctcacaacgtaatgcaaaagttgttccgcgtagaaccacttcgcacctcgtttttggtgaacttttgatatttggccttctcctggcgacatctccacagctggtagatcagcttatcggttgtagtctcctcaagtttctcgtagcccaatgacgccataatggagtcgaacagctcgccatcaagataccgggagttctccacgcatgccttgggcagcacaaagaacagaagaccttggggatgcagaaatttggtggtcagctggagcatcttgcctctgtcagctgtaacaggcacaaaattgagcaccagcgataatgagatcacgtgatacttctcctgatcgctcttgggaagcggtcgtttcaggaaatcctgctgttttatgagcggatcattcgatctcagatcgatccggtctatcgtgtcgaactcggttgatttagacacagcattagacacagacaggcacccaacttccagcagcttcttctcctgaccctcctcgagtgcaagttcgtttccctcgttcttcagccacttgagcagaacgtgtgatgagtctcctcctctagtctgatcttggcccttgagagacgccttctggtacacttcaaggccgcccaatttctccatttcagagtcgatttgtgttatttcagcgtcgatttccgcctcttttgcctgctcctctgctttcttcattcgtttcttcagcccctgtagttgcaactttcgcttgttcagctggtggtacttgttgataattgagcgcgtggatgcggccttgagcccagttgtttttcgtgcattttgtttccccgtgattggcgattttttgccgaaaaacaccatctccaatgttgagcgagctgctgaaatacgctgctggaaaaatgttcacccaaatttacatgtttcaaaatctgcgtgataacccttaaactcgagagtctaattggcggtctaaacacgaatacccgaaacaccataaagcaggagaatggagcaataataagtagtggggttacattaatcacgtgtcataccctcataatcccttgactcggacaccgacatccacgttggaaaccgaatgcacagcctcggaatactcctgtaacagggtggtgctcaactctaaacacttatccagttgggtgggtctaccgatccccttgactcccatagcctccagaagtgattgagtggtagagctgagttcacttgaaacatcaatgtgatccaagttggactcgtactcgccggacattatctctgagttactcgggcgccgctctcggagctgtttcagttcctgctgttgttttcgcacctgagcttcgaggtccttgttgatttgggtgagagtcatgttcgtaattttcaggtcttcaatttggcgggtgattcgggctccctcggcctcggaaaggtgtgctccgtccctcgttggtgaatacacggagggtgtaatacatggagtgtctcttggagtgtggggtccttgaggagtgctggtgagactttggagctggaccatgtgtggaggagatacacatgcgattctgttggtggagtttggactgggcgacgtgggtgactggacccgttccgtctgtttcatgtctgtttctgtcatttgtcggaacaagttcatgccgttttctgcgttggggtggtctaatttcccgccgtttccaaggtggctgtttttgttgccatctccgagcaggttcataccttttataccctgagtcatttcggcagtgttgtagtggctcaaacccccagatcagacgattatctgcgcgtgggagctgcaggggttgattagattgtgtagatacttggtgggtcgatttcgggccgggaacgtaatttcgagctcggcgtattgtcggggatacaaaagcgaagccgttggtggagcgaaaaagtagtgggcgcgatacggaacgggcttcgtatttattttggcgtcactcggaccagccaacttaaatcggtcagaagaccttgaaagagttcacccttctgggttagagtgtgtttcatggtggagattaaattccaggagtgaaaaagcaagttggggtaagatgaatatgagctcccggggtaggtagatgtgattatagcgagtatattggtactgtatgacactaataggtgtgttctctgctgtcaaattatccggtttggacgacttcgaagagctcgcaaaatacaagttcaagtatgtcgggtccatttaggtagcttaacactcacaacggttaggcacagagttggcggtccaaaacagcttggaggcgaaagtgagacaaactgcggtgtccaggggaatatacgaggtttcacatggatctcgaagggttatgaaagcggggtacaaagtgtttcatcgccctcgaccttgtgttatggagtgacggagatattgttgtggtggttgagccgtttgacttgcaacgggctgaccttagtatacccaatacggagaggtctagaagctggaaccgcagatttacggtacatagtaattagcagtgtcagatgttccacggaacaagcgagcgttgtgtgcgatatttaatgcgacttcgcgagcaagggatgggtacggggcgactagggttgcataatatctatcgtatttggtgcatgttgtagctatttttactgtgctgtgtagctgataaataccgtaatggtgcccagggtacaagtacgtacgagtactcgtccgagtagctatcgcaatggaaatttggggacaactgaggagagatagaaacaggccccttggagacggagaaccatctttcagaatcacgtcgagaccaagtaatagggccctctttcaccaactctactctctataatggactcacacaagcggaagctcagaccaacaagaacatgaacgagcatcttgggattctgttgtgtattaattagcagaaacacaagacaagcggcggttctgagatgactgcaagtagtagcggtggttagccatacaatacttattgtttagcccaagcacagctgttgctctgctttaacagtcaatgttcccatcatatctcggatttcagtacaagtagctacttgtactcgtctcatttgtttttttggaaacagtgccggccccttataaatacttgtactgcatctcatgcagccgtacccgtgagcatatagaggacgagtgtttcatcaagtcgctcgttggtttgtttttgcatgattactaattgagacaaatatttgagagagtgatgtccgagctggaagtacagtatgtacatactcgtacatgtacagactcaaacataaagaagaaatccggacttctcaatgatcttgcactatatacccctcttaagacgactgcgaagcccatcttcattattactaacactctcgacaaaaaacatgcttatgcttatctacccactggtgacagatgaactcgagacccatagaacgccacagaatcacagtgaagcaaagtcatgattctaacaagcaattatgttcctcaaacacccttcagcaatattacgagaacctctcgctagtcgccgtctctccacccagccggcatatccgcggcatgtccagatatagttcactatctcaacgccgtctactctttccaacatggtttatatgcagtggtggatccaaaaccaagctaggtagccaaatttctttctcctgacacatacacaccacataaccgcaatcaccgacaaaatgaccgatactttcgatctctctcttaaatcagccaacaaaatctccgacaagctgcccaaggagctccagaacccccagatcggtatcgtgtgcggatcaggtctcggcggccttgctaacgctctcaaggctgagcctcaggtcacaatcgagtacaaagacattcctggcttcaaggtctctaccgtggctggccacgccggcaagctcgtcgttggtctgctgggtgagaagaacgtccctgttgtctgcatggtgggccggttccacttctacgagggctacgacatccaagacaccgtcttccccatccgagttttctcccagattggcattaagaccgtcattctgaccaatgctgccggcggtcttaaccaggacttcaaggtcggagatatcatgcttatcaatgaccacatcaacctaccgggcctggcaggcaacaatcccctgagaggccccaacgacgagaagttcggagtccgattcctacctctgtcagatgcctacgaccatgatctgcgacgagccgtctacgacattgccaagaagcagggcgtgactcgaggcatccacgaaggtacttatgcattcgtctccggacccacctatgagtctcgagctgaggctcgaatgctatctaccattggggctgacgccgtcggtatgtctacagtcccagaggtgattgtggctcgacattgtggaatcaaggtgcttgctctgtcactcatcaccaacgttgtcgttctcaagaagcccgacagcgctctgaacgacaatgctgccaagcttgatgagggtattgccgaccacagcgaggtcatggaggagggtcagcgagctgccgatgatctcgttggcatcgttaccgatctggttaacgttgtttagttactagtttagtcgacattatctattttactgtgtgacctgtagtgcagttatctggcaactgtatgggtaggtgcctccaattggtgatctcgagacacgatctttacataattgaacatagtaggaggtttttctacagtatttataaacattgaaacccgtattcccattgcatgtcactacaatttctcccgacaatactcatacatatattctctatggttactcctcgacaacaccagcggactcccactcgccagtgagattctccttccacagagtgaccttgttgtcgcctccagaaactgccagcacgttgccggacagagaccagctaaccttccacaccacatcggggaaggggatgtcctgaagcagcttcttcttccatggctggttgccctcctgggtccacacaatgacggtcttatcctgcgaagcggaagcaatgtaagacttggacagaacagaggaagaccaggcaacgtctcgaacccagtccttgtggccagaaagtgtctcctcaatcacgtaagtcttggaagaggggtcgtacttccagatcttgacgaggttgtcgcatcctccagtgacaattcgaatgttgtttgatgctttgccgttgatgggctgaatgagcgagccggacacggcagggggagcccaggaggcggagttggcgcccacatcatgggcggcgaaagtggtggcctcgcagttacctccctccttgaactcgactacggacacgttgccgtcggaagaagcgcataggagtaggggcccgtactcctggggagcccacaccaccgagttgacggaggcattgtgctgatgctgagcaatgttagtccatcgaccgttctcctctcgccagatgaacaccttgccatcgtaggaggcagaggcaataatagagccgaacttgggatgggcccagctgacctgccaaacggggccctcgtgtcctcgcagcgtctcgacgagtttgtggttgtctccatcaatctcgaagatcttgatggtcttgtcagacgaacaagtggccaatcgcttgccgtagtagtccaggacggcgtcgtggatgaggtcgtcgtgcgtgtttcctatggtcacctgggttagctgattgccggatcatagctgtcgtttccatactcaccattctgatggatagttagatatgtcgtgttctcacgtttgagttcagtgatgtgtgtggtgggtgtgtccttgcatacggtactcgtaacctgttgtagggacaggagcgacgcgggagggagggacaggcaatttcagttgacactctgactcaaaccaccatgggattaatgttggtaattcaccactttctatcattcatttcatcattcctcctacattgaggtgttgtgcaacgtgtacctgcaaattaaagttgtaaacgtaagggatcatcgaagagacgtgaggtcgtggaaacaagtaaacacgtaaccacgagggagtggatgttgatagagaaagtggtggagaggtacgaagaggtataaaaaagctctaggataacggatcagacaaaaaaaaacagctctaaatcaatagaagggatggttcactatggcttgttgtcagcttgaacgaaagtaaagtaaaatacttaacggtaaaccaaccattcgcatactgacgcacaaataatttctgtcaaccgtgaacatattcttttgacccaagtatttcgaattggaggagaactaagagagtgaaaggttttcaaaataagagaaaacccatggttttggtgtagccattcaatcacgcactcctgtcatatcaaccatagccatctcttacctcactctcctccagtatccatttatgtagaactctaataagatcttgcatgatatgacaaactgaccattgttgatacggcaatcacagtggatatgacgagccagttcaaaaacagcatcaatgactacctggaaggtcttccggaggcagtactaactcggctgtaccagtctccggccacatgtctggcggtgttccgactgctacctgctctggcaagaacactcatcatgggcatgattttcaaccccgatcccatagcagtagccgacgtcgacgctctggtgaagccttcaagtcagcgactcaagctcgaaacacagaagaaactgcgactgctccacattttcacagagacccaggcccatatcatcattaatccgacattcaaaaagaacctgagggcagctctggtaggaggagaccagaacatttcgtttggagtgccctgcgacacggaagacaaacacaaggtggatgtggcgtttttggatgctcacgctgtctctcaatgggagatgatcttacattttatggtcggaacgtcgattggaagaacacccagtgatggagtgctcaacctgctgaagcacagtggacttatggaacccgaacggggaggactgagaatcaccaatgcaggattccagttcttgctacaggatgtaaatgctcagatttggacactgttgctccagtatctcaacatgtccgagtatctgcagatggatcctgtagacgtgctcaacttcattttcatgctaggttctctcgagctaggccaggactactcgctcagtgcactctccgagacacagaaacacatgctggaggatctgcgggattacggtatcgtctaccagcgaaaagcatcgtctagacgattctatcctacgcgactggctactactctgacatcagaaacggctgcacttagaacagccagtcagagcatggaagcagctacacaagacacaatttcgtcttctgttgctgccgactctggatttatcattctggaaactaatttcagactctacgcctacacagagtctccactacagatcgcagtactgaacctttttgtcaatcttaagacacgatttgcaaacatggttaccggtcagatcaaccgagactcggttcgatttgcgctctcaaacggtattactgccgaacaaatcatcacatatctctctgttcatgcacacccacgtatgaaggggatggaacacgttcttccccctactgtggtggatcagatcaaactgtggcaacttgagatggacagaatccgagccaccgacggttacttgttctccgagttcaaaaactttgacgagtacaaggatgtctccacttatgccaaggagctgggcgttctcttgtatgagaatcctggaaagcgaaagttcgtgtctacgcttgctggttctcagcagattgttgagtttgtcaaacgacgaaatcaaaagcaccgtagctccgcaaactgaccaactagaaattgaccatcaaaaccatagcatataatagatcgcactaataaaacaagcgatgtcaacgttgaagttattcaatccatactatatactgcccagacatttccttcattaaagcccataagcggaggaaaaagcactgtcaatatagacagtgacagcatcgctggacccgtcggggctgagtcgctcggactttgccaagtctcgcactagctcgtccagtttggtagattcaccctcaagctcagcgacagagctgttcatgaggaagccggtgacaaggtcgtcgacgccggcagcaagcttataaatacgggagttgacacttacaagtctgtccttggaagtggcatcagcatcagccttgcatagagacgagtatcgtgatgccagagcctgaacgagcttgaatagggtaatgagctttgcatgccacttctcagccaaagcaacaatttcgtcgcttcgggaagtaggggcagcgggagcagcaggttctgcctcgtcatcagtgtcttcatagtcgtccagtccaaagggatcatcatcttcgtcatcagcattatccagccactccttgagctcgttaacagcatcagtcatgaccaaacaggtctccttgagacgtctcttggcgacgtccaagaatggggtcttgcagaactcctggacggcgttgcagtatttccaggtctgagctactcgaatcagttgcttggagtatgcttcagcagcaatctgttcctcttgctcctcagcagacagttcggggcccttgacttcctcctccacagtgaggttgccaattgcatcagtcacttcgtcgtcactgtcacctacaggcacgttatcaagcatagtctgggcagccttactatccatcttcagaagagactggacaacacggctgaaagtcgaaataccaccacagacatctctaagcttaatacgaagctccttttgcatcaattcgtgagcatcactactgtcagacagagacacaaagttctgatactctccagtgaaggctggcaacaccttacgcagatcagaaacagtatgaacagcaatgtccacggacacagggggcttgaaggccacaccacacttggtcatgtgggcatggcacaatttcgctaggtcgctgacggtggcgaaaatctgctcatcggtcttgtcggtcttcttctccacactcttggtctccttccacacgatatctgttgctgcgagatcctcatcgagctgtgtgagctcggcaaacagcttgttgagcttctctgtgtcggggttgtcgggcttgagtgccgccttgggcttagcgggccgtcttttgtttctaggaaggaccatgatcgtgtaatgttagtctccaaacgggttgatcaaataaatttcaatctaggttttcttgcaggagatggtgatatggccagtatgtacaaaggcggtgggttcttctcgctataagagattctgttgccactacagtaataccgatgcatcatgtaacctgtaccggtacttatagaacttcacgattcaaacgccctactacagtaagaacatgaccggctcgtactctcatatcaactcacatcaagtaattacagcatacagtctcgtcaacttatagtagagaaaattggctacaaccataacacacgctcttgactatcatattacaataccaaacaccatcagagtaaatcaaacaacaaaaggctgcgtaaaacacataattctctttatccgcatctatcaacactgccttcgccactttgccaccacttattgtacatccaaatataagccaaatataagcagaccttaatcgctctccaaacctcccaacacacctcctatcgagagtttatcaacacatcaccacattgtactacagcgacacacgccaaaatggatgaggatctaatcaagaccgttaaccgtcttcaggtgagtattacgagatgatattaacgggacatatttcgaagaagagacatgtgacacggagctggatattgtgttgtgccaatcaccaacatgtgcaactgtaacgtacacctggcataattcgatgacaagactcaacacagagggcgacgatgggctggacacagaggttatgtcgtggaaattaacattattacgaacgatgtgatgttccgaggcttctacctactgatcacagtcaagatggttctccgtaatctgtgcatagctagcagaatgtctaccgtgcacccccacccccacgacctacaagctcgccacataaacagctactaacccaggacgcattcgccacactcggaactactgtcaaccctattgatctgcctcagatcactgtggtgggctcgcaatcgtccggaaagtcgtcagtgttggagaacattgtcggccgagacttcctgccccgaggaacgggaattgtcacccggcggccccttgtgctccagctgaccaacaaacccgactcggaagagtacggagagttcctgcatcttcccggcaaaaagttcaccgacttcaacgagatccgaaacgaaattgccaaggaaaccgataaggtcaccgggtccaacgcaggcatctcatcgtcacccatcaacttgcgaatctactcgcccaaggtgcttaccctgactctggttgatctacccggtctcacaaaggtccctgttggagatcagcccaaggacattgagcgacagatcaaggaaatggttctgggatttatttccaagcccaatgctatcattctgtccgtcactgctgctaacaccgatttggccaactctgacggtctcaagctcgcccgagaagtcgatcccgagggaacccgaaccattggtgttcttaccaagattgatcttatggaccaaggcacagacgtcatcgatattttggctggccgagttattcctctcagatacggatacgttcccgtaattaaccgaggccagaaggacattcagtccaacaagaacattagcgctgctctagagtacgagaagaacttttttgagggccacccctcgtaccgagccaaggctcagttctgcggaacccccttccttgctcgaaagctgaacatgatcctgcgacaccacatcaagtcacagctccctgatatcaagagcaagattcacagcactcttgcgaagtatcagagcgagctttctgccctgggaggtgacgatatgcttggatctccctccaacatcgttctcaacctcatcactgagttctccaatgagttccgaaccaacctggatggtaactctcaggacctgtctaccagtgagctgtctggaggtgctcgagtctcgtttgtcttccacgagctctacgccaatggtattaaggctattgatccctttgaccaggttcgagacgttgatattcgaaccattctgtacaactcctctggttcttctcctgccctgtttgtgggtaccgaggccttcgaggtgattgtcaagcagcagatcaagcggtttgaggagccctctctgaagtgtgtcgctcttgtctacgacgagctagttagaattgctcagctgtgtcttactcgtcctggtatgaagcgataccccaagctcaaggatcagatcttcactctggttgtctctttcctcaagcaggctctcctccctaccaacactcttgtttctgacattgtttctgctgaagcctgttacgtcaacactggtcaccccgacttcatttccggccacaccgcgctctctcttatccacgacaaacaccatcccgcaccaaagactgaggtgatcaccggcaagaacaagcgaggatctcctgcacctacacagactgcacagccccctaaggatgaatcgaaggagggcggtttcttcggctcgttcttctcttccaagaacaagaagaagatggctgagatggaggctcctcctgccgttctcaaggcttctggtactctgaacgagaaggagtccatggagacagatgttatcaagctcctcatcacgtcgtacttcaacattgtgcgacgaaccatgaacgatttagtgccgaaggtgattactcttaacctggtcaagcattccaaggacttgttgcagaaggagctgctccagaagctctacctaaatgagaagctcgacgatctgctacaggagagtgattttaccgtccagcgacgagacgaatgcaaaaagatggtggacagtttgtcccaggcagcagaaatcgtcgcttctgtataattagacaagtacaagtagagaaaagtcttatagtaatgttatgatgaatcaatgaatcgggtggaggtaccgtacaattaccgcagtaccatatacaacaccagaaagatgcagagtttatcgcaagtacaagtacatacagtacaagtagtacaaagtgcaaatgctcgtactcgtacaggacgtgcagagagcgggatcaagttggctcgtatattattgccacgctttcaagctcccagacccaacaaggttgtatacatacaataaaccgcttgttcatattccacttgtttgcattggaagcaagtgagtggtgtgatattaaagctgctaaagaactatctgtctccgaatgacgatttttcagtcacgttacccgaaggttcttcggcgggtctctcggggccaggggggagacgagaagattttttccgatttcatttgcttattttaatccaattcttcatttgcgtttctgaccggctgtatgttgacgtaatcgctaatcgggattgtctgcaaaggtcttcctgaacactggcgacgcatcgatgcgtcgggttgtgtggttatttcaagaccgcgcagcatctcgatgcggggccatctcgtattagcagttacactgccttctataaaacgttccatacatgtcataatcggtctttcgggcgtgatagacatgccggctgagcctatacagctttcgacttgaagattgttctaaaaatattgtaaggtttggcccaaattgaagagagagcgggtgttggtggaagcgagcaaaactctgtttggaccttctggcaggtggaagacctaggtttataggtggggttgtaaagcggataacagtaagcagagtggatcgataaggaatgggagcgacagatatagtgtagtaatttttctagcatacaaatacgatagatgcatcctctgatatgaattcccttgttcgcagtgttgttcatgtgttactccactgcacagccgtgcgtgcactatccttgtggctgtgttttgctgtgcgtctgggactgcataaaaatcagtccctagtctacctttggaacgaaccctctgaagattatcgtacttgtactcgaacttgcactcgcacacttctcatccaaacgtcgtcaattacactgcaactatcaccactcagttacagtcaaagagagagttttaccactatcagccagaccacaagtcatcaaaacttcagatacacactaaatcgtcatcacacatctgaactaggatcatcgacctactgtagtcagcgacaccacttgtattacgacacaatactacaacacacacacacacacacacacacaatgggcatcaaggattggctactttcaaccgagcgaggagagaccgtggacagagctcgagagatgctctcggaagaagaggctatgcgccggtatgaggagctggtgaaggccggtttcctggattccaaactggctccttctgtcagcacgtttgcacgagtgcgatcgctactattgattttcctcgcagtcggcatcgttgccggtgtcatctatgtgtcctgggtcgtctaccttggtttcaaggctactgtcaaggagggtctccagcgtcaccacatcaaggtgtcccgagacggagctcaggtggaagtgaagaatgtgacccaggaacgaatgattgagaaggccaccaaaaagggtcttagggcatgggagcgaagtgacgcatggatggcttccagcgtagctgtccagcatgctaatgaacgagaagctgcacgaaagcgaaacgcctgattgcaatgatttaatcgaacatatgtaaatgaatggagttaaaagtattatgaaaatacggacgtcggagatatgctacagtacagcgaggttcttatcaagaatgatatggcgtttatggttggccttcacaaaatcagggggatcatgggaagttcgcacacaccaccaccaattttttggtattttttatttcaaaccctgcaattgtgtcttcaggctgaagggaggttgaattgtagcgtcaaaacccacgtttaaatccctatcctgtggatatctacagtacaaatactgaacccgtaagtctctcacaattacgcgtacagatagttgtgcaactaattatgatgcactgtaagatgagattccaggttcatcgtcccacagaatcaatcccaactctgataaaaaatctacgacgagtgctaattacacgctatcaagacatttcacagacgccatacagcctacagtatgtaggcgatactataaaccagtctactgtactggtagtacagcacctctggagtacgagcacaagtacaatatgtactgtacatacgataatagcaacgcgagtctaatctatctttttgagcgtcgttaattgattttcctaaatgacactttcggaaataaatgatgcgtcctagtagcggcccagaagagcccagatctgaatccagacatccaagcatcgcataaacaccccgaacagcttattaaacaccatatcccgctctaacccgttctttggctcacgttccacccttttccatcactaccatctctaaattatacttcccccgataggtcatgtgacggtccaaagtgttgaactataacccagacatctcattcccacagtaaactcggagaatcagctgaccaacgcggagttttttgtttcctttcgagatttattgccaccgggctccaggccagaacaaatttcgaacacaaaaaaccaactactcgccacttagcattaccaccccccccaaaagccacagctgagcactgcacgctggaactctaacgcgcactccaccatctatatactcgaacacaaaaaccacgcttgccaacaccagcaccacagctcaccagcccaccaacatggaagctatcagtttgttgtccagcgatgaggagtctgacggagagtctttcaacaagcacctccaaaacctttcgtctggaggcggcctcaagcgtcccttcgaacaggcctcacctgtgccagttcaggccaagccagacaatggcctgaatgcctacagagactctctcaaaaccatgggaaccaacaccagcttctcagcctcaagcattcctggcgcgttcccccaggcttcgagttctcaaaacgaccccaaacgacacaaagtggctgaggaaattactctcagctctgattctggagacgatgacatcgtggagactactcctgcgccaacacagctctcacagacaacgggggttactatgagcagtaagaacgccaagctggaagagctctatagacaggcagaagcccagttctacgcaaaccaacaggttggagtaagggagcgatcggtgggcctttcagccatcaaggcgcgtcagactctgaaggatcgacttgccattgccgaacaaaagtccagggaagcccaagaacgtctgcgtgctatcaacagaaactttgacatcgatcacgacactagaatcgccatggcccagaaagcagatcaaaacgcgcgtctgctgtggagcgagaagggcgctcgatcgcaagcgctgcgtgagagaacgctgcttatgcttcaattctttgcagagccagacaaatatgttcagcatgtcatgcagattcttctccaagccagcggcattactgtcaaccaacataaccagaaccagcagcaacggatgcagcagccccagcctgcacatgtgcttccctaccagcgaaacccatccagccaccgtcctcgtgcccattttgatgtggacatggtcaacgacggtatcgagttggttggagggttccccaacgggcctcgtactgcaccttctctgtttagtcgaggtgccatcgaacttgattcggatgacgaggaagcatacagtgccagcgcaggcatggatgccgatgaagcagaaagtatccgtaacctcctcgagtctgccacatctggtctgggcaccgatgtcaacgacagtgcatttgacgatgtggagaacatgactcccgagacaatgcactccaagctgcttcctcatcagagtctgggagtcaagtggatgctggacgccgagaagaatcagcagaagcgaggaggactattgggtgatggtatgggactaggtaagacggtgcaggccatcgccctctgggccaacaagcccacagaggatcctgaggagcatgaccatgtacctagacatgcaaaatgtactctgattattgctcctgtcggtctattgcacatgtggagtaacgagttcgacactcacatgaaacctgatcatcggccccgaacactgctgtaccatggtccatccacaaagaagcagtacaacacctgggagaagctatccgagttcgatgttgtgctggtgtctttccagacgctggtcaccgagcacaagaagatgttcttcagttccggcctgaaagtgactgaaaacatccggggccctgatggcagaatgcatcgtcacagacgtgccatgagacccgaagagttccaatcggtgtcttctcccttctatgagggtgacgcttacttctatcgcattatcatcgacgaagcgcactctatcaaaaaccgaaacactgccagcgccaaggcctgttacaagttagacgcggtgtatcggtggtgcctgaccggtactcctatgcaaaatacagtcgaagatttgcaatcgttggtcaagtttctgcggattaagccctacgacaaggagaagagcttcaaccaccacattgcctctggtatcaagaaggcggcgatctctggtaaagcagtgcgagatgatagtatgaagcgtctacagtcgctacttgcgatgatcatgcttcgtcgaggcaaggactcgaagattaacggagcgcccattctcaatctgcctcctaagaccgtcgagactgatgctattgacttctcggaggatgaacggaagttctaccaagatctcgagactggtgcccagcgacgagtttccaagctcatgcgacagggtggtattggcaaacactatcagaacgttcttgttctgctgctgcgtctccggcaagcatgttgtcattaccaacttgttcgagctgctgaggatggagcagaacagcaggagctcactcgagacgagctgtcgtttgtcattgaaggctgcaaggcttttgcccccaacactgttcttcgagtggctacgctgttcaagcagatgcaggacgctgatgatcttcgacggcagactgagggggacgacgaggaagggactgcaggtgccaagattgaggagatcatacctggtgtcactcgaacatctgccaaagccgagaaggttgatcctatggttgaagacgagttgaacaccatgtttggtgttgtcaacgacactgtcaaggatgtcaaggccaaacaggaggaaagggacatgtccaagtttgttgtcaacgatgatagcgacttgtcttctcttgacatcattgacgagcccagccctgatacctctgctgcttcgtctatcaacggacgagatgctgtcaaggctgaggctgttcccgtgattcccaatggcggttctgaggctgacactgcttccaacggtggtataaactacaaggaagagtttcctattaccaacggaactgttacttctgtgaagggtgaggacgttgaacctgatgtcagtctcgaaacgcctgagccttcgatccaggcacctcgacgacgaacttacaacaatgctgtggaatccgacgacgacaaggacgattctcccgttggttcacgacgagcgacccgatctcgagccgtgaagattggcaatgctgccgaggactcggatggtgagggagagtggcttgactccgacgatgccacttgcagtgaggaagaggatcctcgtgatcgcaaaggcaagggcaaggctcgtaaccagcgtgtggaccgtctaaagcgtcttcgagagcgaaagttcggctttcctcttgagacctgtgatgagagcgagacacctggagatgcgtacgacgacgctcaaattgctcgtgaggagaagcgccttgctgaaggattcgaatgtcccatatgtacagacactgttcctcagtctcaggtccgtctcttctccacttgtggccactccatttgccacgagtgcagtgtctcctacttctcttctgttgtcactcctctgtgtatgacttgccgagaacccatcagccagagcacgatggtgcctcttcgggtgttccagaaaatgcatctcgagaagaagtcccctcgtgaggtgactcgggagattcagtctgagcaggcccgtcagaagaagcatcgagaggcagagaagcagaagattgaggaggaggatgagaagctgcctccttcagctaaggctctgcgatgtgttgagctgctggagaaaatcaaggaggagaaccctggagagaagaccatcattttctcccagtttgtctctttcatgaatctgattggcgatgagcttgacaatgctggcttcgaataccttcggtacgagggtagtatgcatgctgatgagcgatcacgggctgtgacagctttccgagaagatcccagtatctcggttctactcatttcgctgaaggcgggtaatgtcggtttgacgctgacagcagccaaccatgtgatcattatggaccccttctggaatccctacgtcgaggaacaggccatggaccgagctcaccgtattggccagcagcgagatgtcactgtgcacaagattgtgattgagcagacggtagaggaccgtattttggaacttcagaagcgaaagcgggagatgatcgagtcagctcttgacccatctggccagagacagatggcacgtctttctcgagaggagttgctgtttttgttcaacatgcgacccaacccgaacacagttgccgaagctgccgccgaagctgctgctgcttagatttaagtgatacatattatttatttgtgatactgtgatgcgtatacgtagttttatctataaattaaacacgctcggcgtaggtcttgataagttgaaagacttgagcaaagagtgtgggttggccgatggcgctaacgtccagacttgggaactcgacgtcacagtcgtttagtagaatgggcataaaaatgaacctcgaaacagctccctttgctatacttgacatggctgttattagaatagccttgaagtatgaacagctcaatacgatagtgagggcttcaacgacgttgaaattgacagcccagcctaccagagcagcagcaaggggcacatcgtagtcccagatgatcatgagaatcggcagtagttttgttgctgatgaaatgagtagtgctgtagacaatgcatttgggcgtttccagcccaacagaatccttgccatgacacgtaccgagatgtgccatgtgactgcctcagtcagacagatgatgagaaagtagttatattgtgtgataatgggcagtcccaggaggtaacgcgttaatggcgtttgtggtcccttctccacctgtgcccacgtcaggtacacttcaaaaagggtgatgagcagaaacagccgtcgtactcgagggtgaaggttgtcgttggttgtgcttgggcttgtgtcaggtgtgagcacgttgaagaccaggtgtcggtaggcctgtttcttgagcagcagcaggtcgatgaagatgagcactccgtcgtgttcaatgtatttgtcggcgaatttgttacatttggagcatgcagtgagtcgaatgttatcggttgagtactccgtgtataatgatgacaccggttctgtacattctatacagatcatgttgtctgatgtgtgagactgtaggagagttttggcgtgttctgcactgcatgaagtgtatctggggtgttaagtgtgcaagaggaggacactcgtactggtggtacagtagctataggaagatgaagcaaccagaatgagggaaaagcgatatatattgtgtcgccaatgcaacttcattgttactatccgggcgacccgtcatattcttgaaaagtgttcctgctcataccaacgagctgtaggcccgttcgtacagtacaagtctacaggccatatttccatcttgttcgcaccagactacataatattaactacatgacgtctgaagtaccatggcatggcaggtcatcaaacattacattacaccacctctaacaaaggtccgtctgcatatgcgttagagaccctttgccaaatgtagcaatcaggtcaaaagcataccgcagccaccccagtggcacaaatccgcattccgagtccacttacatgaaatcgtcaaaatcatcgaagttgtcgttgaaggtagaagtatccttatcgtcattgatcttggcggaggcagcagcaagaccgggcttcttcttcttacctcgagcagccttctcctctcgaatcttctcattctggtaagcgttcagggtagagatgagctttcggagctgctcgaccttgaggggctcagccagagccttggtgaaggtgatggcaaagtcggggtaggccagtgggctggtcttgttaaggtctgtgaggatgggggccagagtctccttgaggttggtgaagtccttcttctccttggggtggaagattgccagatccgacaacttcatgggagcggcaggggcagcgggagcaggagcggcctcagcctttgcagcgctgtcagcaatacctccagtgccaccaaacagctcagaagcgttcatcatgtcggagtcgagctcggcctgtcgctgtcggtctcgcttggtggaagcatcctcaggcttgagcttcatggcagccatctctcgctcgatcttggcgatctgctgtcgctgggccttcttgggggcagccacggtggtcttgggtccgggtgccttggtgggctcctcagcatcccaggagtccatgacgtcctcctcttcgtcgtcatcccagttggcggggactgcgggggtggcagcggcaggcacctcaaagtcttcgtcgtcccagctggccatctttttcaatacgttgtgtcgtgaagttgtactatttcggtaatgcaaagggtcaaatcaaaatttcaaatctttaactagggtacgggttttcccttttgccatgtcccaatttcgtgtcccataacctagacttaaaggaccattatcagaacctaatgcacgatatggaaagtgagcccatcccgagacatacgagatctctcaactaaaccactctaccactacacgcaatgaactggattaaggaaggaaaagtgacgctcacaaacacagagatttttgagtctcctggaaagggcaaagggctcagattcaccaaagacaatgtctccggtattgttctgagagtccccaatgatctgctcattaacgccgaacatgtatccgcctggaccgaggagaacaaatacctcaccggagagcatttggagtttatgaaagcgtcattggaatggctaaaatctgagaaagatgtcattgtgctgttcatggccctgctggcttctcagagctcatctggtatgagcgattatgtgtcttctctgcccaaaagtacggagatggaccagccctggtcttggcccgagactgagatctttgatagtctcaagggaacctctctcctcatggcgtgtgttcacaagaaaatgcatgtgcaggcaaaatatttggcaattgtcggcaagaaaggaggagagaaactagtttcagagcaacagttctatttatccgagcaatgggttgtgtctcgaagcctggaaattcctgagtctcctggatctgaaacgctggctctgaccatggtccctgttcttgattacgtcaaccactcacccaaggcaaattgccgatttgaagtagacagtggagaggtggttttaattgtcaatgaagatgtgctaattaaggctggcgatgaggtctttatcaactacggacctgataagagtgccgcagagttccttttctgctatggcttcattgatgctgctcacggggtcaccaagagcattacccttgagactcctctcatgctgtctatggatgagattgatcccgagtatctcatcaagaaccccgactgcgacgccgagctcaagagcatgattctcaagttccatagctacggagctcgatctagactcatcaaactggaggctctgaatgacggcgaagacatcattgccaaggtcgactgtgactggttgtggatgcttaccctgcccgtggaagatctcaagatcgacgagactactgcagctgctgagttcaagggaaaacctctcgttcgaaccaagactgttcgcgcacagctcaaacagattctgggagatgatcttaacgaatacatcacccagaccagcagcatgaaagaggacatcggagactacgtcggccatctggtgagagaggtgtttattccccagctcgatgttgaggctaaaagcagtcaccccatggccgaacgtctcagacagatggaaaagtccttcctccagtctattgatgacattgaggtttagtcgttgcctacatcgacagttcattgtaaatagaattaaatttgacatgttgactgatggcaaccgtaagtatctatccagtggctgcttaaagcctttttcttttgtgatctattcaaaactagtagtcgtactcaggatgctcctcctcctcaggcttcacgaatcccagctcagtaagcaccttgagaggggtttcctctttgaagatgtccagctgctcctgagacttggccagcaatagacctacggttccagtagcattcacgctgatgtccttgtatgactccttgcttcgaggcacagccatgacccatttgtcggtgaagacaacattgtatgagatgctgggagcatcattgactctgagctcggtcagaactcgggacaacacagtgctgaatttgaatcccagctcctcggcaacggggtcctcaatggccacctcagtgtcgttatcggccttagcatcttcctcagcccactctgcctcccaaggcacaatgaagtgtgcaaagggcaccttttcggacgacaaaggctgctgaccgggcttgtagtctcgtccctttgctttgattaccgactcggggaaaggagtgaagtccttcggcagctcaatgaactgaatatgcttgtgatccacagaggctccagaattgggtccgcagttgaagaagccaatgtacttggcaccatccgattgggctgcctgcaaagcggcgtaagagtactccagatcattcggggtcaggggagcagtctgggggatcaccttcttggagatgcacatgaaatggttcggaacaatggcaaacttgttcagaaccagagagtagtctccaaagtcgggtacgagcatgagcttggggtcgggcttctcaaaggggttgaacttgggtttctcagtcttctcgtcgccattgttgtcgtccttagtgggctttttggccagggcaggagcaaatgtgtatcgcacatcaactccgttatcagtagcagattcctgtgtactctctgtgtagatgagatcgccggactttacagcggcctcgaaagtcttggtaagcagctcagggaagtgggtaggcagtgagggtcgtctgaacatatttgtggcgttgcgtgaatgtgagagtgtagagcactggaccatgcaccggtactacgcacagaactaagttcaagtcatgtgccgaggtgggccgagtcccaatgagtgatcatacggtggatacagactgtgtcagtcgtagcacccatataatttgatgaattgaccaagtggttactggattacaacattacgtgttcggcagattccacaatttcgttttgcgcgcttctatggcattccatggagaagctgtgcatgatttatgcttccccagacatctatgagatgaaccagtgtggttgggggtgcaattggaacacagtatgagagtagggtgactgccacatgtgaagaaataaagatttcaatatacttgtcgaggtcaatgactttctgtgtggtacattcactagcatgtgtctcttcaatgaagcgttgtctccctaagaaacggacagagataatactcacgagcttactgtaccagtgggagaaacgcagtacagtagttgggacagttaagttatccgccaaatctcttagttgggtttaactagatgatccctacagtacttcaagcaaagagtttaatgtattatgaaaaaaatgcaggagaatcaccttctgctccttggtaaaacgtttgagctttaccctcagtacaaagggattttgcaccgtcactgtacttttgtcatgctcacaaatgttctcttagctacattttatcactatcggcatgtcagtctcggggtcttacgcagtatactggtcttcccagtgtaagtaagcactgtacccagcatgttggtcgtactcaggtattggtcttgacaatgatgtcgtaaagatggtgataatattctccattaaaaagataatgcactccttgcaaaaaaggagatagactaattactgtacgtacagtactacaagtagagaaaggcatccgccttataaagttgatctatcgcccagcttcaagcccaaggttctggtcacaggatataaatacacttgacgaaacacagccccacatcataataggtgtcctttagtcagccgaaaaaaataaaacaaacaaacaaagactctggattacttaattcctcgttatttttcattgaaacgtcaaaacccccttgtcctactccttccatccattccctgtcccttcttgtacactccactgattagggtagattcccaatcaagccaacctaaaccgtcctcctgcatattccaaacctccatacaggcctccatacaggaccatctccacatactttagtcggcacccaacatccgcacccgacatacgtcatgattgacagtatacccgaagaggaccagccggactttgctgggtttacttctcgtgcgcctcaggctcgtggacgacgcttcagccaccacagaagttcctccgactcctcaagctccagccattccccccacgctttgcggggattttccggaggtccatttgtccccgagctgctgcctggtttcgttcccggacagtccaagccgacaaataacaatggctccgctaacatgaactcgaatccagctcctcagcaacacactagcatgcctccgaatgtaccccctccgccgctacctagcaccaacaacaacacgacgacgaacaacaacccgtttggaccgatcctgagcagctacccgggatataacagtccccaaactcagcatcaacagccacagcagcccccgcagcagccacaatacaaccctcctgcagcgccttatcagcaccaaaatggaacccaaagtctggggcctagcccacaacttcgaggagaggatttcgtcaacatcggccatcagcaacaccactacgcatcacagcatcaacaacagccacttcagcagccaccacccgttcagaatcaggctaccagatcggcatctgcaggaaacctggtccgtccgaacgccccatttgctgccaacagtgctacgacgacatcctctgtgccatcatctccctctgcatctttctacggccagagcgactcgaattcgactctcatcgggtccaactattcgacaatcaatctaagcaatgtcagtggaaacagtccagttactccgacacactcgaacccaggtctaggccaatcacaaggatacggtgggaaccctggcattggctcctattcgtcgaatagcagcactaatacggtccaacaatctatgagcacgctcgatggggctactgctgccactgcggctgctactgctctcagaagggtatcatctattcccatccagtcgactcaacggccgatttcccaaaacgacaaccctccagataccagtcccaagaagacgcggtcatttggccactcaaataacccttttggaatccacttacatggccacaatggcctcaaaaattcaaagctgggtaagaagatttctggaaaacgttcgcccagctctagccccaaaaacgtggctactggttccactgggtctaacaacgttgccagctcaagcgcagctatgagtagcagcgcgtctgtgaaatccgacatgagctctgtggttggtggtatgggaaacaacaatgacgttggactctctaccacaaacacaacttccacagacagttcgacagctgccgctgcagctgcgtatgcccccaatgtgccctctaaacagtcggctctgtttaaggcaaagctgtttgccaaacaagcaaaacaacaatcgtcagccaagagtttaaagcccaaactcaagcgcaaaggcaacattgaccttactattcagacacaactccccagcactcgtccttcactagcagaaagaagtccactgaacagaccttccaaggaactggaacgaattgcaagcatcggcagcaacgtacccatcacgccaaccatggcgtctggcagaggagattacaaccatcccttgacagccggagctaaggatgactctcccagtgcgaaaaacaaggcccactccattctgctgagagccaagaaggatgtgcattctgcggctgccttcatgtcttcgtcttcgtccaactccaagctcatcaacgaacagggcggttccttatactcgttccagagctcctcacctggtgctttacacaagagtttttccagtgctctggaactcaagaatttcaaccagaccaaggaggataaggaacagctcgctgacgacgcatgggcgcttctgtgttctcgagtgcttcccttgttttcaggtgaaggcatccgagtccccattgaagatctcaacaagctggtggtgatgcacactaatctgcggatccaggagcatgtcacagccaagtctttgttgcaagaattcaaggacctgctgagatctggcatgtatacgctggactctactatgtcccgtgtgccagatgacaagcttattgctcacctgacgacagtttggggtcacttcttctcagacgtgctcccttactgggagggtgtctttctgcctcttcagcaggagttcgatggttacggaaagagcatgaagcccgaagagagcgagaagttctggggtatgttgctcatggaccgtgatcagctgaacattcgtctcatgactctgtgtgcgttcagagactacatcattctccctcactctgagcggttgactcgaatcatttccaatttcgagctatcttctcagggagccaacactcccgttagactcttacagtgtttctccatcttggcctccattctgagtgctgatgcgcaacagcaaaagatggacgagctggtgaaggtgctcaagacaggatggttttctcgttccagggcaggcaaggacagacgaggcatgattatcaaggcctagaaacgcgagacccgttattatctggccagttatttatttatatttattttactactcaattgtatattatcgtagcttccgtatgtgcagttagttcaagtacagtacagtatttagctactgcacgcggtggccagccctgctaataatctgaaagcacactatcctgtgatatactgtacgccaccaaatcgtttgtcaaaaatgcaataaatatattcgtagacctatatatcggtccatctgttagaggccaaaactggccaggtcgtccatctgcttctcaagctccttcttggtgacgagccgcttctctcgttcttcctccttctgtttcagaagggcctcgctcttttccttcttcagtgtctccttggatttaacagagtagacatccttgagagcatctggatcgttgacgagatccagcagagccgagtccttgtgtttctggctcttctgtttaggcaccggctttttggctgtcttttttacaccaccagtcttgtcacgtgttggtctggaaaatggacctgctctggcctttgattttgtcacgttagtctttgccatggttgtgtaatgtctgtggttgtgttgtatggcaacgcctctcaaaatatttctctttaggtggttcaacgtgcataaacttaattttggtgtgtgccacctctaaactaatttcccaagtagctattgattacctaactactaattccaatccgccaaactctgatagaaaaaaaattgagttttcatgcgacaaatttatctcgtccaaggtagacagtttcacgacacactacacagccgacaatggtctctactcataacaaagacaagccatgggatcagccccacattgataagtgggccgaggatgagttcaccgagaaggacaacgcttccggtctgccctttgccgaggagtcttccttcgccacactgttccccaagtaccgagaaggctacctaaaggaaatctgggatgatgtcaccaaagccctcgaccaaaagggtattgcatgtgttctggatctcgttgagggttccatgaccgtcaaaaccacccgaaaaacttacgatccttacgccattatgaacgctcgagatctcatcaagctgctggcccgatcggtgcctttcccccaggcagtcaagattctcgaggacggcattgcatgtgacgttatcaagattggtaacttcaccagcaacaaggagagatttgtcaagcgacgacagcgtcttcttggacccaacggtaacactctcaaggccctggaactgctcacacagtgctatatccttgttcagggtaacaccgtctctgtcatgggtccctacacacatatgaagactctgcgacgagtgattgaggactgtatgatgaacatccaccccatttaccacatcaaggagctcatgatcaagcgagagctggccaagcgacccgagctagccgaggaggactggagccgtttcctgccccagttcaagaagcgaaatgttgctcgaaagaagcccaagaccatcaagaacaaggttcgaaccgctttccctcctgcccagctgccccgaaaggtggatttgcagatcgagtctggagagttcttcttgggtgccgatgagaagcgacgacgagccgacgaggagaagcgacaacagcaggctgctcgaagtgcagagaagcaggcccagagagagctggccttcattgcgccagacgaggacgaagagaaggccaagaaggaaaagaagaaggagaagaaggaaaagaaggaaaagaaggaaaagaaggagaagaaggagaagaaggagaagaagcgaaagagcgatgacagcgacgatgagggagagaaaaagaagaagaagaagaagcgatccgtggagtagcttgcttgttcagtaaaatagatttgtaatgcataacttggttaaaataaattaactagctaggctagagagctattctaaagtgcaccaacctcgaccatcattaacctggtagttacacagtccaggctcaagccagagactgactagaccagcaagaacaataccggcagaatcactcataccaacactaccaagagcaaactctcgctctgccaaatcagcctgttcggtaatcagcagaaaggtgttgacataggcagctcccccaagcagcccttcgtagaatatgagaatgaacaccagccagacgttgggtaatatcggtgacatagactgtgcaatgcaaaacacgaggttggcaaactggagcactgaggggatcataattcgtctaattctcacaaatggtgcactcgaacgtgagataaatactcccaactggtatagtgttccataggtcacatagacatctctgaacttagaaaagggcaactcttccatgggaaacagaagtgtgggtgccactccctggttgatggtgtactcggaaaagtagaccagaaacaaaggcagcatgtaaggcataaccagcggcttcaaacggaccattgtagtttcgtatccagaagcaacaaactcccaggtgattggctgtgtttcaatacctgtttcagggtcattgctgtgcacagggaaggcccctggtacacggttataatctctaggaggaaggagatagaagtagactcctaagaaggccaggggaaagaatgcaaagacaagcaatgacgtcttgactgaaactccgagtaccgtggtcaagagcatgaacagcccgctacccactagccctgcacctccagttccgctgctccacccattgagagccctggtatcgtaaaaatgggttaattggagaaaggtgacctcgcccagaccggaagagaaagaagccagcaccactcccacgagtttgagaaacagaggagatgctagtgacacagacatcattcccacagttgacaggccaaccagcaatgttattcggcggttataggggattttgtggataaaaaatggtgctgccagctttatcaagaacgatgggagtacgtcggccagtaacaccacggccttgggtgtttgaggtcccaccaggtctactgcggcggtcaagataaccacatagagcacgttgttgaccaacccaaatgtccaaaatgcggcgtacacaagatgagcaggttctagttgcattatggttgctgaaatgttcaattccttgacatgagtgtgtcagtgacttttcgagtatggccgtcgctgggtggctggagaagtgtgactggttgtttatcagtgagtgtcgctgttctgtgaagccaattatcccaacacgcatgggacaggcaagtctaatatgtggaagtgtgtggtgtgtggagggcgtgaatatgtgcatacaatagctcgatacattactaatcgaaatcgatatattaaccctttatccattcgataagcaccattattgtacattctaatggtaaacacgcccccgtttctactgactacaagtagtaagactacaagtaggggtggcgttgggtcgtgtgagtgaacccagagcatggcgtagtcagccctatcacatacagtacactacagcacgtagctacttgaaaccattgcagtttatagattataactagaaattcagtacatgtacgaagagtatgtcgggtcattacactgttcaatacctgctccgagccgaacatatcattaacttatcccagtacatactgtacacctctgatggcgccccattacaattgctaagaaaaacgacagcagcatctcacttccaccacaacataatatacactctattactatccaattaaatagtgacctcgggcttgggctccacctcaactccctctcctccgtcaagagggtagatagaaagcaggttagggcctcgaatgaccgccagaccgatctctcgcaccttgccttccttttgaccctcaaactcggcaaagtcctcgctctcctcgtcctcgtaaatggtctccttgacgtcgtcgagaatcaagttcatgagctgatcccagccctttaaggtgccctcgatctttcggccagtgaccttgacaaccactcgcttgttctcgaatcgagacagatctagaatgggctctcgcttggggaattccagcttcttggactggccctggttctgaccttggccctggccctggttctggttgttctgctgctgctgattctgttggtgttgctgattttggtgctggttgtgtcctccataatggccagcgttgccatggccgcctcggccgcctcgtcgctgttgttagtacgtgtgaatggatggctgagccttcgatccgctatactcactcctccacggttgtcgtgtcggtccattattgatgatgatgaagagttgtcaacctgtgcgttaggttatgagagagagctagtcccaggaagtttaatttgggggtgtggaaggtgaagtgttgataatacgacagttggtaagctgaatatatacgagtctggtctcatttggaagctactcgtccccttaatacatcaacatagatatcttatatagatgttatgactttcgaaagattaccctctaaaattctcaacttcacaccaacaaccccgttggtgacccgccagaatactcctaatatcagccctcattccgagttgaaagatattctgtctctccatgatatgggtcttctttttcgttcatcttggagtccattttttcgttttcaatctgagacttaggttatgagtacataccccaggggcgcaactttattcccgcttgttctacaatattaagctattgtacccattattagtcaaacattaggcgaccaagtggattgatttctgttcaagaaacaaagaccgaacaaaatgtgacatccgtattccatttattgattagttttgtttacatgagcttagtgtttcaggcaatttcacaaacaaaatctgttaacggaaaaaatactataattaaagttatttgagaaatgaagacatcctgaacaatatggttggcataattgtttagttggtgagaagaccctggagtcgagagttaagaccaacaagcatagaagcatcctgtcggaaaccggggataatgtctgcgagcaggttaccggcctggttgatagtagcgatgaggcccttgatgtcatcggcaaaggtgttgaccaacttgttctgagagatgacagtagaaagagtgatcaggaagagaccaaggttggtaatgaaggcattcaggccagtggagatgaacatgttgacgagaaccttggtccagccagcaagtccattgtagttctgcagccactggatgagctggttgagagctcccttagcctggaggatggcctgggtgatagcagcgttggcctgctggggggaaacgttcttgagagcctggatggagttcaggaagagagatacaccagcgttggtgaagctctggaagacgttgaagagagaaatccagtcctgagcagctcgggcgtcgagggcaacagcatcgtcaacgaatcgcttggcgatctcgctgtttccgccgaagtgagcctcgacaacctgtcgcatctggatgaggccagcctcctcaggagcgggggcagcgagggcaagagtagccatggaggcaacggcgagcttggtgaaagagaccattggtaatgtgttgattggagtgaatagaagagagaagagaagaaagggtagttgttttctggatattcgagaggaggatttcggtggtttatatagagtcctggaaacagggtatccattcaatgccattgtatcccacagcaccttgtatgacaaggtatggctgagttagagtcccgctactgcagagacacggaatttgtgcgtcagacccataggcaacaaagagctcgtttaggtgactacaggtctatggtttgagtctacttacctcggtaggcagtgtaaagccggttttggaaggtgtctatccgactcggcggacttggatgctcacccaagacagatgtgttgcattgttgagctttgcttccaggtacctacattgtacatacgaagaatgggtgtttcataagaatcgcacactacaagtagccaacgttgttgatcaccgcgttggttgacgtggttagggcggtcagtgctaaagctataccttgagcttctcagtcccatggttaggtatccaaataccaacttcaacacacccctgcaatgtcactttgactttttggtggatacttacagagaactatgaagattcagggagctgagtggcctgagatggatcgtagggaccttccaatgtgcctggctgctctcttagagacatttctgtcattttttacatatacgccacaattataataggagagcaacgtaagtatgtctgtataatagttatagcgtgtaggcgatttctgtctcaacatcaagacgccatgtttgtctgttccgaccactcttaagctacggtactactttgcttgtcgaaaggtgtaacgagctgtacgttcagactaacgaaagactgcacggaagttctactacaaaatatagcgaaaactagtagtagcattgctcaagagatgtgcacctgtaagttgacagaacgcacccgccggattgatgaccccatgatctttgtaaccctactgattcgggccacaccttagcactaaaggtggatctccatgtacgattaaacctaactgctatgtgcgcctgatcaatgcaactgtgtccgatggatttgtgttgctgacgtgaaagtcgcatccacgaaactaatgccgaaacggtctcgttttgccgcattgtctgtaaataaaccgcaacggatacttacttgcaaccacgggggcagatatggtgtcccatcttgtttgcagcccacagtagtatgcaagtcgagactttggctgcagcgactcctgaaccttgtcccaacgccatcaatcaaacaatatcgaacaaacaaccacataacaagcgcttctgtaagcgtgcaaccatgtttggttgacatatttcgctataaaatgtggggtatcctctcctcacttcttttgcactctatttctgttttttcgcccactcaactctcgttccaatatgcccacgttatgccttgcaaccccggttttaaccaagggtttgcaaccgaaaccctatccggatatgtagcttgttggatctgggatgtgaacatggtgccctgtcagttacaaaatagtgtcttggtacaatacaacagttttctacaggtgacagttcaccgcattaattgactgcttgtagcttgacaccaccgcagccgtcgagaatccacaggaggtcatcaaccgtatctggggatcgtcagtgatcagccagatttacgatgactttcacaccttgttgagcggtcgactctggtcatagagcgtacattaaccataatacaaatctattgcggacatttattaccaccctcctctagtcaggtacaattgactactgtagctatggcgtcggctttgttggtgtggcttccatacgctagcagtcatcatcagagcaacaacgccggaagtctacaagtgtcgtttattcgttctcttagtctggaatgaaatggtaccaactgtcagtctaaaccgaacaccccaccgtcagttatcgtggtattgtcaccaattggccgttcgagggttacaatgaacgttagcatcattctcgagctagcgtgtttcccgttccgtacggtgtccattcctactctcgagcatatgcgtagcaattctcacattcacgttgatatccactcggtaactgctttgttcaatccctacatgctgtctcaaaccatgtgcagggtggctgtttcagtgatacggtgggcctgtcgagccctgcatcttagggttccgttagtgcttcactaaagggcgcttaaaaatccgtctcttcctggccgccttagattgagatcgtcgtcgccatattgtatttttgaattcggtggatgtattgcctcttgagaatccttctccatttctttgtcgctggttttcagttaaacattttgcggggtcatagacacaagctctccctactgataggcccaccatcccctcaccccctccttcagaaacaatactattgttgaagtggccccgatgatgacagtcgttaatacaacggcgtctcgattgagtaacaagggtggtgacggtagcaaacagctaaaatggatggctgcctctttttttttcccagcgtgttctgggcatgataagctacacgtactgtagaagctactggggttgcaaaccccagcaagtagcttggtttattcttctgtgcatgaaagttacgagtacccttgcgtcgggcttgatggacactattgacagttgacacttcaatgtgtggacaatgctagctacagaaggctccttaagaccgggatgtaaacgtgcatacgtactgcttccataatcctctgcgacgtcacgttttcaatatttgcgtcgcttgtggtctttctagcagttgctgctctgctacagtatacacagacagtagcacatccactaacttcaccttttgaactctccacatcttcgatagtcaattaaacgaatgtaacctcaacctcaacggttactagcggcccgcgaagttctcagctacttgtagtcaacctcccccagagcaacccttccattgtgttgtacccgccgttaattggcgcaaaattatgtacgggctggtcctcccctcattgtctctagaccctgcgttgggttgagtttcttagatattctcgatactcagtccatactcgtactcatactgtagctactgtactcaattgagtggcctaaatggtttgtgattcctgcccactaaatgtggctctgcccacttctcgactcccttgatcgtgagttagactcactcatatgcccacgtttttagccaccagtaaagtggtttctggctagtggcggttagtccttggcggggttgttgatctggagaacgtaagtcaacgccccagaagatcaatgttacattgtgttcagattaatgtagtctgtgtagggagagatgacccagtaaatgcacccgtgcacaattagccgcacagcaacggacagccatccgtatctatccagtctcttgcggaaacagcttctgaagacgtttccacacatcctgtagttcaggtcaatgttacaccatcttcacgtacatactgtagctacatactgtttgttcggttagaatcattgcggagcaagaaacggaatcaccgtacaagtacgatagcacgaacctcctgaacttcttacggaagtacaggctgctaattactgtttatgtttcgttttggagcttagtgcagcattgagcttcacaagagtatcggatgagattacaagttgaggagtctgaaagtttcgataatcgtaattacgaacaagcgcaatacactccctgcatgttctgcattaccgttgccctttatgagcggggtttagtaacttcggttggtggagaattgactcactattgaacaagggcgtctagtgggggtgggtgcttgtattaaatacagtcttagcaccggtaaaaaaattggggatgttggtggagagcactgcttgtcaggaacctgcgaattaccttgtctcaactactgtgtacttgtacgtcaattactcgatgtatcaaatgaataaaatcaataagctaaacctattgcttctcggtggcctcctcccttgagtcaaagaggacgttttcgtctggtcccgacacctctcttgttccggtggcatctctgaatgtcagcatcaaagggaataatcttgaacgttcgcttacgagcccttctcttcttctgcgattctttagtttgagacggccgggcttcctgaagaggctgtcccgcataacctgttccgggagagggaaattatatccgggatggggagaatagtaccactgtggagggagataaggtcctggaggtgggtggttatgggcaaagggatgaatagcataaggctgtttgggtgatgtgggtgactgttgtttcaactgcgctaacttctgttgctcgcacagcttcgaggcctcctctttactaaggtatctcaagacttaagtcgggctgccatcgcacgaacctggtcgacgggttcatgagcttcacgtgtagcgattgggggatagagattagatagggtgagggaggctttgtggcactgtcagccctaccattgtcctagtcttcgctgttgttttggtctgctcagtcacatccgcgtcaaccaactggtgaaaaagatgcacgatcaagctcttgctctattctgagcaaaaactcgttgttcctgaactggtcgcactcatctcgcatgctgtgagttatattgaatcaatgtgtgtgattctgatatcatccctttgaattattcaaaacaaatacttttaatttacttatatattggttacacatactcagatattgtaagattcggaattatcttaggcatttgaccattctggagggacgtgctgtaatacgacgatactagagagcgaagtgacagttcatattgttcaagggaaaacgactcttctcggtctcggagagagacaggactccaagttttcatcgcatgaacttatagctctaacacatgattacacgaagtacttgtactcctggactctctctgcacccttccaacagatacagacgagttctgcccatataagttaagatcctcagctaagcttgcgcgaagtcttgacaaagcagaatattgaggaggcttgggcagtaacaggtgtttgcagtcttgacgctactgtgtattaggaagtgaaacccagtagtggagtttcgtctgcgatttttcctgcttcttggtgaaaataagggtcagcgtgttttcatctctctatagctggtattccgcagctattccggtaaaaatggatctaatagctgacaaacgagggctattacaccattctggccaataatgtactacattatataccctcaattataaatctcccggatgtgtaaactaataactaataatcaaataaaatatttaccaattcatgattggtttcgtgtcccacgatcaatcttatcgcgtggccatgttcatcactttcaccccggtccatctactgaatggcctcatagacaacaccaataccgtacagccagttgaccatatgaccgtgcataccaaccaacctgtatccagttggaggaatcagctcatgagggtcacctccgccagtcttaccaaccagggcagatcgtcgtcggttagtaatgagctgaatagcgtcgagccagtaacctgctcgcacgaagaatcccacaatgtgctctccaggttcaaagattgtctcggtcatcttaccgcccctcttaccgaaaagcacagaggatccctgtgtgaggaactccacaccgtcaacagcatcaccggcataaagacgtactccaacaaggttgtgatggccaaagtatgcctttgtctcgtctccaatcttgtttccaagttcgtaagactggaaggcgttgttctgatcacgtgcacagagagccttggagaaatcgtcaatggtcacctggccaccaacactgagaatctccagccgcatgggcttcttggggtctcggtattgagggtccttgatggcctgtcgcagatcatgttcaaacaagaaaacctctcgctgagggtcctcagcaaactccagatggcctcggcaccaatcctcaacatgcacctccaccaggtagatgcctgaagtggccttggcgatagtaccattctccacagggtagaggttgggcttgccaggggcagggaagtgttcgtgaggcagtcggaaagagggatgatgtctgaaacgcagagcatccagtctatgccaggagcactcgtctgcggggaggcaaggtcgatggaatccctttcctagggtgacctcctttgccaggaatgatcggttccaagtgaggtagcctcttagcatgataccatcgggctgatgggggcagcccaacaggtgaccgatctcgtgcataaacgctccctgggagacgttgagtgcctcccatgcacttccgctctgtcgagagtcgttcgcgacttctcgaacatccaccatagtgttgtcaagaagagcaggaaccatctcctccacacaagagggccaggtccagagggcatggcctccgaaaatggcaagtcgaacgttggaaatgcctcctcccagagcagcgtgtccggtaatgagttgtcgcttgatgttccattcagagtcaacgaaaacacaagcagctcggtgttcaacctcatcctgggtgaatggcagaccgtgtcgcttaagagcgtcgtacgcaatattgaagagcttgccagtgtccttgccgctgctgttttgctgggcgtaatctggggagttgatctcggccacagaaagctcgctgcgcacaatgtgtactttaatggtgctcctacatgtcttgctctctcggttactgagagtatcaacgtcccattcctcgtggaaccggaaagttcggtttccaaagccgtttcgtagcatgatttcgttggtaaaggcactcatcatgtatccagccattcgcatcttcttgacagctaggtcaagagagttaccctcgatctgcttcttgtagctctggctctggaattcacccttggagtctcggcccagaattaggcacaggtgaagaggtgggtcctgcagcagcggcgtgtagatgagtgtcaatgaggtagacactggctgtcgattgtcggggtattcgtaggtcacacaaagctggttggggccgggagcaagatgcacaaacgccttgaagtagttgtcggcgacggggaaccgctgagagggaaactcattgaggtggtgggtcacgacaacgtttccgcagttgatagcatccagtcccttgggtccagcgttaccatggacaatgacgaatcgttcatgcattacatcgttgtttcgcacattgagcattttgggggcatcggaccggctacccgagctctgagcaggaggaggtccgggtggtggtggggcacccataggctgctgctgttgagatgcaggaggaggcccaggaggaggtcctggagtgggcccatggttctctggtgtagtctgagagcctccggcatagctggcatggtcgctgccgtagtattctctgtcgtttttctttcgtccgaaaagtcccttcatcgttgtatggggggtaggtggtttagtgtggggttaagaagactggttcaagttcgagctggaagggtggttgatattcagtctaggttgataagcgcaacttaaactcgatctgcatagggcgatgcaccatgacgactggtcctggaaaccgctgaaagagcgcaattgaatgtctgatgtggttttgaatgggttataggggcacatatatattatagatcggcttgaggccatttttttatgtgtttggggttcacaaatcaccgtaaatcgcagataattgttgtctcaccacctgacacgtcatgactggggtataacgcggatatgttgtctggaaggttttttgacgacacaaagctatcaatcgactttgagtcaactttctgagctttccaagctcttttatggtgaaatatcccctcaattccgctctccagcatctttccggaataattgactcgattggtgctgcgcatattatgcacctgctgcgccgatgtcacaaggtggcgtagactactatcaagatgcaaaagggtctaagagacggttacaagcgagatgtttttataagtatgtttcaaaagtgaatctcttctaatatcctcggcattttgactcacaagttctctggcatcagaatctcagacacgttctatacaactccgacttaggtttcgtaaaagctgtgtgagttgaaacgtccacgcgaggtccttattgaggttcagcctcgagcctctggagagacgggatgagattctcagaacaagcacacacccacgattcatttttacaagtacaagtaggaggaactacaagtacttgcaataaaaagaagagcaaacttcttgtttgccactatacatggctagcgtctcaaattgaactgtttggacccagctcatacccagctcatacaccttggattaattattccggtaatacacactactccgacatacagtagcttgtaagtagtgccgtaggaaccaacgttaaatgaagggtcatattcaaggagaatccgcactaacaaccaggctataatatgacgtctctcagttgacgaacctatgctcagcctttgaatgtaagacgccaagtcactgatatttgtgttccttagtcagacactagttgtcacaactgcgaacaataatacgtatcagtgtctgtgtggggactgaagggaatgaccgtttggggcgggccatgtgtggtgagttattgcagttgtaaccgaggtggtcgcattcagacctcgttaacttacatatgccaataattgaggaaaggagaatcatgtcgaaatacacgtgatcaaaccgcatgtgtttatatgaaatggataccattaccacagaactgatagtgtcttcgcttctctctggcttggcccaagtccaggatttggctgtgcagttgctgagatgcaagtactcgtagccactccattgtacttgcaccgtggcattagacacacgatgtccataaattgatttccccgattgatatttttctcattttcccctatttttcacgacaacttctcatttctcgacaacctgtccggatcaactttggtccaaccgttatgcacgcacagaaatgcattctcctgtcaatgtcgagtatgtatgataggtgagacctctcaacgtctgtcagtgccgttcattataaactacactgtacttgtaggtgttcacagacaccggcttctgtacttgtacttgtaagtgaaagcagctctgtctatatacaaatgtagaccagaaccacttacgacggtgatcatggcttggggcttattttgacacagccacccattcgggccgtgtcttgtaaaaggggttaacaattgccacggttgtccttgctagctaaaagcaaataaagcgtctaaaacagagaccaaaaatctacagtactactcgtactttgtagccagatacgagtggagcccacgcaatgtcacatgttttcgtgtcttgatccaccttaaactcgtaaaacttgacaaatcgcgttctgtagatcactttcagacacagcaatgctcatttaatttcactctccacgcgctttatcgttctcgtcttttacaacagagtttgtgctttcaaaaacctacccccaataggcgagattgatttgaggtggctccacatcggtgactgtacaagacaagctaggccctctgcgttaccagggtaaaacagagaaaattggcacatatcacagcctctgagcaccacatgaccgctccatgccaccctgcaactatacctctctcctctctctctcttatttactttatcccaaagtggcatgcctcatgcccatttgggatggtgccattcagaaagggatacatgattggtgggctggagtgtggcagttcgatcctgctgaagcccgaggtacaaaaattctgcagcacccagtcgcaaccggcatccgctccaaataccagcgagaaatcctatcatgcaataatttttgaacgaaccatttttcgcgtggttgcgacagccttgttcatgtcaccactccgacgtcacaccgtgcatatccatgcaggttacatgcgctcactcacgtcttccgggtaactagtcggaaccttcgcactgctcgcaccagtcgcaaacctaaaacacgatccctggatcaaaagcgtgtcctgtagagtcggattgttcttgtcgcactcacacacacgcacactcaaccaacaacatcaacaatgtcgcaaccccagaacgttggaatcaaagccctcgagatctacgtgccttctcgaattgtcaaccaggctgagctcgagaagcacgacggtgtcgctgctggcaagtacaccattggtcttggtcagaccaacatggcctttgtcgacgacagagaggacatctattcctttgccctgaccgccgtctctcgactgctcaagaacaacaacatcgaccctgcatctattggtcgaatcgaggttggtactgaaacccttctggacaagtccaagtccgtcaagtctgtgctcatgcagctctttggcgagaacagcaacattgagggtgtggacaacgtcaacgcctgctacggaggaaccaacgccctgttcaacgctatcaactgggttgagggtcgatcttgggacggccgaaacgccatcgtcgttgccggtgacattgccctctacgcaaagggcgctgcccgacccaccggaggtgccggctgtgttgccatgctcattggccccgacgctcccctggttcttgacaacgtccacggatcttacttcgagcatgcctacgatttctacaagcctgatctgacctccgagtacccctatgttgatggccactactccctgacctgttacacaaaggccctcgacaaggcctacgctgcctacaacgcccgagccgagaaggtcggtctgttcaaggactccgacaagaagggtgctgaccgatttgactactctgccttccacgtgcccacctgcaagcttgtcaccaagtcttacgctcgacttctctacaacgactacctcaacgacaagagcctgtacgagggccaggtccccgaggaggttgctgccgtctcctacgatgcctctctcaccgacaagaccgtcgagaagaccttccttggtattgccaaggctcagtccgccgagcgaatggctccttctctccagggacccaccaacaccggtaacatgtacaccgcctctgtgtacgcttctctcatctctctgctgacttttgtccccgctgagcagctgcagggcaagcgaatctctctcttctcttacggatctggtcttgcttccactcttttctctctgaccgtcaagggagacatttctcccatcgtcaaggcctgcgacttcaaggctaagctcgatgaccgatccaccgagactcccgtcgactacgaggctgccaccgatctccgagagaaggcccacctcaagaagaactttgagccccagggagacatcaagcacatcaagtctggcgtctactacctcaccaacatcgatgacatgttccgacgaaagtacgagatcaagcagtagattgttaagatgcaactagggaaggggaattaaaattcatatagcaataatgtataatagctaggaaatgtgtgtggttgtagatcgacacttgtatatagcttgtgtctcactttgaagaacccaattatgcatgatacatgcatgattccacactacagcaggagtatggtggattccagaacaagtgatgatgatgagtgatcagcaggttttgggaagtatctgtctttaccaggaggtgtcctaagagcttaaattgaaccttgtacggattgtggcggcaggtactgttggtttttacgaataaggataagtagctcagctgctttcgtgcgaaaagtgtatagtaggcattttcaccatcacttactatagataccggtagtagatcgtgagggctagagatacgtgcgatacgtgctgttactccagagaggttagataagaaccaagcactttctatcatgaataatagtttgctcttcaatagggtgtgattatggaacgttttggtcacccttgtgcttactaagtaccattctcaagtacatacttgaccacgttgaactaagtgctaactgtctatttgtagctactgttacaccagtgcactgtatgtggggttgctaggtgccagacattgcaagattcttacaatgacacgcgttatttacaactattattaatactgtaattggttacgtaatagctggttggatacaactactctcactggttgttgaagtacttcttaccagacctcatcttggccacaagtgcgagtgcctcaccatatgctttggaggttgtggcagggcagacagacttgattgcaagggccagcagtcaagagaacgtgacgtatgaaggaaaaccgacagtgaaactggaaaataaataggctgatagattaaaagaaaaacaagtcatgtaataatcataaaaattcacttctaaatacatctgtgcacacgaaaaacacgagaagtggagctcgtgtaggaccaatttcacacccaaatgggacaacctaaatcgtagatgaggttttgacccataatgtggtgtctctgcacataaattgaacctatcgccatgacgacgcgtcaaccatacaaaccaaagtacattccgctatacgctgcaaggtcggaaaagaaggagactgaggcgccggcacacaagctcgagcaacaagacatttcagagctcaggcagcagattgacgactttcgagaagaaatcagaacaagcccagtttcttaccccaaagaaccaatggcagaccctcacagacgatttgccattccaacagatttgtctcgatttgagcggctccgacgaggtctcagacgcgaagaggacgcggacattaatctcggcgcaaactactcgcgatacagactggaaaccagaaggaacgtggaggacgacgatgaggtccccgagacaaggactacacgcgtctccaagagagatcgagatcacaatgaactttcgacgaatcaaacccggctgcggagcaacagcagatctagaaaccctccacaacaatacctcaacaaattgcacatacagggggaggaggagtttgaagaccagtacgctgagatcaaggaggagtctcacgacgaagacacgtctctgtatcatcccatgccacagatgcgccgttatgcaggctacaacgcgttcacaggatcgcctcagaagaaggtgacaattacggagccacaggagaagccacaggagaagcatatgagacccagaagtcgtgatccggacaccagggcagagcatcgaattcacgaagccacacgactggtggaggacaagctcgagcagtatatgggtgccatcgaggccagcaagggcccagaggtggctcagcagtttgtgcgagagtacgagctcatgatggacctgctgagcaaagagtatcaggggtttaaagattttcaacaaaagcaacctacccagacccctatttcaaagacttcacctaagtctgtctcgaaaacaacacaaaggtcagcttccaaaaagggtatcatcaaaatgccgactcaatccgccagcaggagacctactgaggacattaatgacgattatgaggaggaacgagacattgaacaagactacggaaagaaacgtcctcaagtcaagattgagaaacaagaggaggatgctcgacctgagaatgatagcagaagggcccaaaaaggcatgcatgagttagaaagggaaatcacacagacaccgaccaaatcgcttgatccacacacccctcaaaaggtggtgatacccaataccggagtctgggcacgagcccggtctacaatctccagatcctgtagagccgttgttgggacctggcaaaccactacatctcccctacttcttctggcaacctcgttcttcttctggcaagcaattcgattgtatgtatacgcgacacttttcatcatccccccttacctaaactaacacagggctctcacctttttctgcctggatgacgacgaggagtttgtgcgccagcagctggttcagggcatgagctacgctgaaatcgaacacatgtggggcctgcgaggcttcaatatatgcggtggggtgtggaggcctccagttccacagtagacacgacacgactaaccgcgctagagacaccatgccactctaactgtacactatctaataaatagactgctaacaatgtttgtggagggttgtatagccgatccagctcatagtaggttcgctatacatgtacagtatgttcttggagatgctttcagtgattacagtatgtggcgaaaagaggcgagaagagtgaagtacaaagatgaaagggaataacaagcgcttgaaatgaaagaatgaaagaatggcaaacgaaaaaatctgtcgagaacatatttttcttcatattctgtgtgaataatatcctgtgtctatgctttcagacgctcgtgtctgccatcgcacgatacaatatgggaccataaatcaatgttcaaaagctcatccggctaactatattgcctcacaatataaaacaaaggtacaggagcactctctgctgcaccttcctccctgtgtcctcgacttccacacccccaaattcacgccaacattacataagcaaaatagagttccttgcataagactgcacgtcatttaggcactaaaaaaaaatgttctccgaagtattgtcaccaatggcaaaacgaacaactaagctgccgccagctacagtggctacaaaggcggatttgaggaaccgccctatcgcacagcctgtgagtcggcgtaggggccaacaagcaacgcctaacaacgccaacaacaacagcaataacaacagcgcggaagacaaaagtaacaacacaaatgataccaaggacagcaaagatggcaaggaaaaggccagcaagaagaaacgaaagaagaacaagaagaagagccaatcgggacccattagtccgcaggaccgtcgaaactctggaaacggatacaacgtcctggtagacgagaatgacgacaaatctggagatgagggagagagaagctctaagaagagaagaactgcgggatctgctgcatcgaccaccgcttcttcagatatggacagcgaaaatgagagatcggtctccacagcacctacatctgccccagctcccaaacctcctgctgactctcctcctcctccaccaccagttgatcccagtgagtggaacatgaacgaggattttgtcgggtttgatttttcggatggtgaggatgaggaagacgaagagccagaggagcccgtcagatcgcgtaagcgaactatcgaggaggtggacgatgcaagttcaggacctgcttccaagaaacaggaccttgaggccccatggatcaagtcaaactaccatcaatacgaccgtgtgtctgattggttgcaggaggaagtgatggactttgtcaagtacatttctcccactcagtcggagataaaggcacgtcaggatctggtggagcgtgttcgaggggccgtgaacggcctgtggggagacgcgaaggtgcacgtactgggatcattcactaccaacatgcacctgcctcagagtgatattgatctcgtcgtctgcagtcctcacggacactacggcgagagagcttgcatttaccagctcagcagtgtcattcgaagccggatgaaggttgcggagctccagactatcacaaaggccagagtgcctattatcaagttcatcgactcgagaacgggcgtccatgtggacatatcgtttgagaaggacggaggaatcaagactgcatctaccatcacgaaatggagcaagagcatgcctgctcttcgacccctggtgttgattgtcaaacagttcctgtcgagtagacgacttaacgaggtcttcacaggtggtctgggtggattttcagtcatttgcatggtgtactcgttcctgattcagcatccccgaatttcgacgggcgacattagccccatggacaaccttggagttttgttgattgagttcttcgagctctacggtgtcaacttcaattacgagcgtgttgctctcaacatggatggtaactgtggttaccttagcaaacgtttgtaccctgatctcattggtcgaaacccctttgccgtggcaatccgtgatcctgatgatcatgagaacaatatttcccagggaaccttcaacatgcgaaatatcaaacgtgccttcagcggtgcattccaactgctgtcgggtaagtgtcttgatatgaacaagactggatataagggacgccaggggaagagtttactgacatccatcatcaagctgaagggtcctgtccgagaccagacccctgatgcaattaccgaacctctcaagtacacaggtggaggggatgagttcaagatccctcaggacgctgtgtacaactccgtgctaatgaacgatgaggacgaggatgagaaggctaagcaagcagaagatgctgacaaaacaaagaggcgtgctgcccagagggaggagcagaaaaagaagaaggagttgactactgcatcagatgacaagattcccaagggtccagcagcagatagaaaccagcccaaggccgatcagagaaaaatgtccaaggatagagccgctgcacgagctgctgcgcgtgaggtgatggagatttcgagcgatgacgacgacggttccgacagcaagaatggtggagctaagagcaatcccattgacttgtcgtcggatgaggagaagggtcgatctgacatcaagaaagatccttcggccaagcgacgattctggcagcagaaaggaggactggattactagcgaggtgcggagacagagatagaataatgtaaattaatggcgttacctacacacgcttcacacaaggcaatctgaatatactaataacattgcaaattaaatgtacttatttaccgccatgaagcttgaaccactgggtgaagtcggcgaatgccttctccttggcgaacttgacaggagggtcattagggtcgcctcggcatgcaaaaccgtggacagtcttggagctgagggtggcgtagtaggtctttccggtctctttgagagcagcctcgacgttggctcgcagctcgggagtgtaaatattatcagtctctgcagcagcaatgatcagagggtgcttgatagccttggcatcctccacagtgacgaaagagggatgagcccaagccagagcgttgacgagatcagtggctcccagagctccgacaagctttcctccgtagcagtatccaacagttcccacaaacgagggcttgaagtcgtccctaatgtgctgtgcgatttccttggcgaaggggatagtggtttcaaatgtgtgtcgggggaaccaatcgttcataagggaaaagctctcaggagggttgagtgcgactgggtcgttgttgaagagatcgggaacgacaacaaagaagccctcctcggcaaattgatcggccaggagcagggagcccttgtattcgagacccagaatgtcggtcaacagtagcacaatcttgtcagagggcttacctgcaaagtaagtctttgttccatgaaagtccttaaactcaccggaaatctctccgtcgtgcttgaaaccggtagcgcagcagggaaggagaaccattgtgaataattgagtgcctgcgagtggagtgtgtctttcgacgacgggaaatgttcagtggctttttgtagattgcgttttagggtttgcctagttggtgggtgacctccatgggctgcttatcatatagtgggaggcgggggctcaagcctacttgtactttatattttagcagataaggcagtaaaaactcgttaatagtagatatactagcacaggtcattcctaacttgacttatcggccctgcccaaccctttctgtgttctactcatcgccattttaacttcccgcagatgcatatgagcatgtgcggactttttgttagaggaggggcttacaaatcacactttcttggctctcggatatgaaagttaactacacgtgctgagtgggggaactaatgagagacctcatacaagtgttgcaagttaccataaaggaaggtcaacagtactggaagttgcgcattctgtgattcaacgaaattgttcttgtgtgttgttgcatgacgagatgtaatgatgatttagtcatgctcgttggtccagaaactctgaactggtatttgtactgcaacggctgaaagttcagcaatacagacgtaaatagaaaccgtatcttgtgtctaaagtggcgcgttgtaaatggtgattaatttttgggcgttcctggacgcggttgtttcaatgacagtaaatgtcgtatcgagtgtcttagctttccaatcaaatcaaagtttcataaacctgcagtgccaagctattagcgatgttcgcttttgtcattactttttctgcagttctcttatcgatcgactcttataccgtaaatgagccggtcatattcgtctatctgtttttcgattggccgctagattccttgttttgaaggcgctaaatcgaagtgcccagatgtattacctcacccttattgatgtggaaggctgcggacggacgcaaaaccggacgcggcttgttggcaaaacaatgtcttataaaaatccctaagacgcaaataaaagcaatagttcacaggttcaagttcaagtaatctgttcagttgctgtggtccgtgctcccgatcacaattgactgttggggttttgttttgttttacttgtacagcacacaatctcttgtctcagaaaagacaaacacctccacgtgcaagtaatgtggggttttgaattcactacaagggtcttctcgtatcaataggtttccctttacctcacgagtcggggaccgacgatactttttgctagtgtcgctgtgctcgtatccagagcttgaaggtcgttgtgcctattgtgcctacagatccggtgttttttcaaaacaataatattaaataaataggcgagttatataagaatgagtgttaagaagacacttttttccaccacttatctaccaaggaacttgagctcgatccatcgagtgcagttgaaactgacaaaggcaaagccaaaggcgatctcgaaaccaatatcagctccgggtccaatgagcttaccaatgggaccagtgtaccagacctgatccataccaagaactgctccagcaattccgacacagaaagaaaacatagcagcgtaagagacgggcaagggtatgatccttgtggatgtcagggttatagcccttgaaacctccaatccagaagaagtgggcagacaggttaatggcagtgtaaacggccaaccagtagccgataatgttcatgaagttgtcaatgaactcctcaaaggcgtagtaagcggcaatagagataccgatgacagcaccgtttccgagaatagcccaagcagctcgggggacaagcttgaacttggaccagatagtctgggcagagagaccaagagagtacatgttgggaatgttgttggcaacagtagaaagagcaagaacgacgatacagaactggccaaatccgtggagagagtcagtgacgaggatctcaaagacaagtcctccaataccgttcttgttgtatccatcgttgaatcggggagtagttcggataccagtcatgcaggcagcaccaagagtcatgacacagatcagaggggtaccgagacccaacatgagagcgcagaaaaccttgacggatgaagtcttcttgggcatatacactgtgtagtcagcggcggaggggcaccatccagtagcgaaaccgaagactgctccaccgaaagagagaacgttagcagcttcagaagttccgacatccatagttccccactcaaaggcgtgagatcgtcccatctgaatagcaatgatgaggaagacaacagcgttgggaacccaggcccacttctcgtaatggtggatgaagtggtaacccatgaaggagacacagaatgtcagaagagagacgataacaatagccacgggaacgggaagtccaccatggttgacagtgtggagcatctgagcagacacgattgtgttgactgtaccccagccgatacaagcgatacagttgaaaaatgcaaggaatcgaacaccctggtatccaaaccagtatcgagaaagaaccatttgtcggagaccaaacttggggccgaagcaagagtaaaaggcaacgggggccataccgagaatgttgaagaagatgatggtaagaagagagtcgatgaaatgcagctggaaaacggagacaccaaggccaccgagagcgaaagaagcgataacaaagttagcggagaaccacatggaagcggcgttccagatactgttgtcagtcttttcctcctcagggactcggtcgatacctcgaatctcagccttcaggtgtttgaggattcggaagaagaggttgtccgggtgagtctggacaatgtcttcaacagagccatggcgagggtattcgagggaggttgaggaggagaggccctcagcttttactccagtttgtttttcgatatcgtattcagacattgagctggtaagaaatcgagccggtacaaggtcaaagtgattaaaggtcaaaaccgggtgtgggagaatgttgcggcagcagctgttgtgtgtctggagagtcgagagctgatctggagtcgtgatatatatatatgtgtgagaaagctagtgttagctttgttttcgctactgaaatactttttcgtatctagccggtgatcgaatcacggcggattatggttcatcttgacgcgggcccttattgttcaatgaaactttctgtcatgaagagtttcatcatgtaaatcaacggcgtttgaaggctacaacaagggggtcactggggtccaatgtgggatagaacccgcccagtagcgggcgataagggcaattaacccgtatgtggtctttgggtgcgcgatttctatctcctttctggaagttcattctcctgttgcgccgcgcctgcgagcctcactgcgcgtgcaaggctacagtagccacactcaggaccaaacgctacatgagtcaaatttaatttcccatctttcaaaactttgacgacccgattgcgcatgatatctgcgttcagtcaaaccagcacggcaaaattttagcttctggctactcgctatcttcatctgcgcctctgtcattggctacaggcaatctgaagcccccgtccaaacccgaactgtgacttttgtacattttaggtaagcgacccgttgactcgggcgacataagttacagaaatagaaaaatttgcggtgactggcaagggcgcagaacatgagggttggcacgtgatgtaaaaatgagccggctggcgatagtagggcgtgtaccgaaaagaatatgtgctatctacatcagggaggttccccacatgcctctttggcgtcccttacagctgtatcaaggatttggtatctctaacgaatgctattacacaattcacgctgattaaagtgcagatggccgtgttaccgacggatgttccgccggcccccaacttttcaggagcggccaaggctgacagagtttgacaatcggctccgaatgaggtaggcgagaccgcttttagttggcgactgcatgatagcagtgcggtaacgtgcgctcactcgtgatgcccgcatagatgaagatggacacaagtgtggagtggaaggcctagggaacgcgtcgtagcgcacggataagcggttaatcagcggagaaagtggatacatggattatattctggtggtttccccaatcctcggattatccgatagcatgtgggctacttaccagcatgatgatatcatctgtcatccagtgtcatcttggcagaccgactaaaaagctgatatggtggtagaacggtatgtagctaacagagtgactgaggacgctatcgatcaatagtgtaccaatagtgtacaccctggacttagctgtcgggtagctccgctttctagaagctaacgagtggctgataggcatttcccttcccgtacgtaccgtaggaacctcaactaatgagctgcgagccattttaggcaagctttgctatcttacagccctatagtcttttgttttacaagttattcattaaactatgggaaacaagctacaaagaagccttggtggcagccagccaagcgacccgttggccgataccgccggagtagatgtatccttgtccctcaaacccgtaggcatgaatgacggtgaaacctcctgcgatagtttccttctcgattctgtagccgccgtctcttccgggtctgaagccaatgatcttcttgataacaggaagaccctcgaactcagaagtgacgggcaacggtccgtcacccttttcaaacagggtggcacgtgcgttagcaatcatgtcggggcaaatagtatcgaccttggtgacgatttccctgttaacttcgtcatccactaccttggaaaagttgcccggctgagaaataccaccaatgatgattcctcctgactggggtcggggaataacataggtatagtacttgccggtacgagagcacatggggccgtcataagaggtcttcacccagagtgtctggcctcgtacagctttgacagcggcatcctgcacaggttccatgtgcttggcaccgactccagaagcattgacaacaagtctagagtggtctcctgcaatctccacggcctgcgcaatggaggagacttcagactggatgaactttacacctcgtcgctcaaggaatgttctcagccacttgagatacacccaggggtttaccgaggcagacaggtactctactccgtgagtcacgtggccaccaaaagtcttctgtttggctcgggcgggaatctcgtggtcctggagccatctgaattgaggaaattctctggcccacattcggttttcagaatctttctcacgcgactcggatccaggatacgacgtttcatcgtaaaagtctctggtgagtcggaatccgagaccagtgaagggatcagcatgatacagttcccaccagagacggaaggtctctcgctgaatgtctcgctcgtcaccttgggctcgagggtcggggtggaacatggcacctccccaaggagacgcccattcgccaggccaatcgtgatcaggctcacccactcgggtgggcatatcacgggcaacaacagtgacttcatggccctcttgcagaaggtagtaggccgaggtgagtccaatgactccagatccaattacaacaaccattatcgagaagtgtgggggtcgaacagtatcgaatggcgccaattgggaatgtatcgctatttaaaatctggtcacttccattcctacccaaaaacgtaacccccaccccgactatcaaacacagtctaatagcgctgcggttggaaccttgagcttgggggttgaagaaatgagagtgttatgtaacgggaggggtaaacaggtagctgaagcaggagtatatgtaccaccgactttgctgtctaagaaacaatcgtatgatggttttacagctcacaccttgcttctcgacatactgtccttgtacaaatgtgttatctggcatacctgcataatctgtataatctgtatcggactccgcattaattgaagggctaaatcatataaccgcagagccgtagtaaatactcaaacttacgcagtacggatgctacagtatcttttgaagtgtggcgtggatgttgatacgtgttgaaacggagtacacagttgcttcttaccacggctactatctcaacgaaggtgataagctcacggatatcgtacatacataccactctacaaattcttgcatacaaacaagtgatcgtacgagtacggtacatactccaaaatgaaactcatgttaatatatacgtgactggtgagatagaaccttacatgtctcggaaatcctcacagtgcagctcgtactcatagtcaggctgcatctcggcgtagagagtgcccatatcgcagctgctatcaaaggtgaactgagcctcctcgtcatggatgaactgtttctggaatcccttgcattcggcagagttggccagcatctgagcctcgcaggatcgctccatcagggtaaacaggtatgtcgcctcgtccacggttcgtcccacagtgagaaggccgtggttctgcagaatgacagccatattgtcacccagggcctcagcgatcttgtggccctcctcatcgcccagaacaactccaccgaaggcgcggtagacagagtgagccttgtaaaaagtacagacgtcctggttgatcatctccaactccttgccgaatgccgagtaggcctttccatgaatgctgtgagtatggcaggcggcgtcaacatcgggacgggccttgtggattgcggagtggatcaggaatccggcggtgttcactgccgcctggtttccatccttcagaatgttacccttttcatcaacatggaccatgtgggagggcttcatgagactgtagtgcactccgatagggttgatccagaaggtgttgggatcgatggggtctcggatggaaatgtggccggcagatccctcagtgtatccctttcggcccatgattcggaacgctcctgccatgtgctgtagcatccactttcgcttctccagaccctggatcttggggatctggtgggggtggggagctccgtgggcaaatttgttttcgggttggacgacttccgctgggctcattttgttgtgtagttgtagtacgaatacttgtactgtagtgcaagttgaagaagagatgcttaccaagtacatttgcattggacatcatgcgctttatcattattctcctgtggaacttaatttagctcaccccacaaaatgagccgaccaaacggaacagaagagggcaacattaccgccacatgagaagcaagtcgaagcaatggcggcgcgacattcaaatatcgacagttacaacaccttaagaacactcataatgagtcagatactacattaatatcccatcgtcatgttcacctgcactccatcttttagttccatggatttattagtctaatgctctggtagaatggtgacagccgggatcggatctgatctgggggccgctatcggcatacctgcgtacttcgctccatctggtgatgaatattatgctccagggatgagggtcatgcggatgtttcgagtgttcttcggttattggtggtactcaccccacagcaattcgacagcaaacctgagccgcaagatgctcatccagcccacatatcggactttcagtacagtaagtacgtacttaggacaagaaccactgacttgaaacaccttcatcaagatgatcctttttggcattaaactggttttcgagactgacgatgcgttcaggggatatcctgaaaaattgaagtttgccttgagatgtacctgcaaagaaatttcctgtacggggtaacgatggctcatcataacagaccgtgtccccagaagccatgtcatagaaaataccgttagtaataccgtaggcaacataacgcttatacactcctttgccttgagttggaagcgtgaactcctcatatcctcccaccaacgtcctgtcagtcacaaaccgcaccttggtgctgttgatgtcgaaaaagaatggcaccagatgtcctccaaaaccaatccacagataaccatgatattgcaatgtcataaaccacatatagtcactgatccactccaaaacctgtatctgcttgcgtcttgtatgatccacataactgatactcgcttgatgatcctcatagagctctaaacacaacatggcattgggcaagacctggacatcactgcatgtacccaagaattggaatacgtaggcgttatcaacatcgacaaccccatccttccacttcatcaatgcccccttgctgcacttttccacaatcaacagctctgacgaattgctgtattccaagcagtggaactccgcaaaccccagactggcataaacgtccacgccgtacttttgctcacacatcttgtgctctggctccgaaatataactgaacccgagcgtcttcatgtccacttccacgcccgttcctccaagtttcatggtcgtcttttcaaaaataggctcaaaatcctctggtaacctgtcgacagtggtcacatcaattaactgaacttttgacggcttggaactggcatcttcgagaacctcaaagtaaatgtcatcgaaagattcgtttggcacttcacgtgcttgtttttgttgctcgaaaacaaaacgtgcacattgtcgccaggtattggcttccaagccatcaacacctagctccacccagggtgcaacatccgcaacagcagagcgtaatatggcttctgagtcatcaatcagggcatgtaagtaacgacaggtatctcctatgttgaccagtgattctaaatccaaatgttggatcacaaggccccatatttcgtctggcaatagggaagctgccatagtggccaaaattaggtgtgatgggaaggaggaaacaacatcacagagcaaacacgaagggatatcatagaatgacttgactcagcacataaatagccgtcaggcacataaattaacaatatgttaagagtacgatgacaagatctgacataaatatttattattactagctattaattacttcctattgtacaattcatcctcttctctccgtcccctgttattcgtatgatgtgtttagtcttcggcgccattctctcctcaattattctcagaaatcagctccttgatgaagggtgggtgagtagggaagaaaagttccagggtcaccgattccggtaccggtttcccaaagacctcgagtatcaatcaccgtgctgtaatccagagctttctgctcgggatcggttcttcgtcgaatcacgccagcttcaagctgcgcagtaatggtgacaacctcatgcaaagtgtcctcgtaaggaacaggagtaccgggggcagaaaccatccaattaccaatagcccagagtcgctttgctcgctgaagtttggcttttcggttgccctttcgctcaagacagtcgtgagcgatgatcactgcgtctcgcacaaaaatgttgagaatgatctggtagacacaagcagcatagcacaggttcacctgatcggtgcccgaaatatgcttgtctctccagtaagccgcagcatgaaggcacaggtctcgtgcttcacccagccgcatggcaagttcagcgtgttgtttcttccagctgtctgtgtccagtcctccaaacatgctcgatagcctgctgtgttcgagcttttccttgaatgactgtgatatggtcacgaacgcagagcccagagccttacaataatcggcaccaaagggcaattctctgaagggagccagttgttgctggaagttggatgtgaatacctgagagaagtcgtctgagtctacgtctgatgcaaagtctgcgtcaatcagagagttgtagaaggacacagaggcctggagggcgtcttgggagttggcgttcttctttcccttcagcatctcgttcaccttgttcttatcccatcccattcgtcgcagcatcttgacgtgcttgtccttgaccaagaccagcttagtgttggacttctgcttgccgtagagctccttctcgatcttggtaaccgtctggaacacagcagactgtgcgctcaggttcttggtactggcgttgcacaccagaggctccatttgtgggaggccaaacagcgatgtgaagaggtcgatggcatcaatgaagcggggctcaaaggcggcgaagaacttggggtcatctccgcaggccaggtagttgtttctgtactggggaacccgcagaatctggtaggcgtcggaaacggcgtagaaactaaggtacgcgtcgctcttgcccagaagcttgatgagttgcaagcatcgtgtgcgataggcctggctgatgtcgaagccaccggcgttgacaggcacgttgaggatctcgtaaagcactagcatttttgctgacgagtgagtttgattgtggcgaacgtgccctttcatattggacacagaaattttaccgcacctctagcaggtatgccatgtagcttgtgctgttaccgtttgaacgttacgcacgtagtttaaccctggcaaggttggttaagtttcagttgggtcctattgttcggcaagattgagattgctattgggggcgtgggccagcatgtgagcagcgaagatacgagtgccaagagccattttctggagcaacgggtctaaaggggcggccacacgagcagtttggagacatggcatctgcatttattatttttcgacgtcgtctctttcccccctccgttagcatcaattcgtcccctcttgttgcacttttgagcctttgaggtgggccaccctagttttccgttgctttgtgcttttccctctcttttctgatcgacaaggtccggacgccgttctgggactatgcttgtgctttagctcagcacattaattcttttttatgtcaaattggaggtgtgcaagcgtgtcatgggaccatcccgctgagtgtatttaggcgagctaattatatggtgcaagacatgacgagatatttcagagcagaaaggggtggcgagtggacattttcacttgtgtctggtagaatccctccactcgtagtctcaacaaacagctcagttacacccgcagtaaggtaccaactgaaatatcctgcttgtttacatgcatcgagaagcgctccagacgcactacttgtactgtagaatcattttcggagtacagcattggggggaatggaggatttacagtgccctgcaagcttgtcatctcgcatgaagcgatccgaagagtgtacttgtaggtgcattggtctgtggtcctaggcgaaataactcactatgtcggagacgtcgttgcacgtatttgatcgttgttgcatgccccgatctccctgtcttttctggcatctgtctcgtctctaatgacgtcacgccaacagggcaacagggtttggtgtagaacaatggtttggttgtacggtgagatcttttgtcgtaatacgacacggcataggaacccgcctttttgggtggagtaatacgagccagttgaaaggtttggtaacgtcgtagaactgccagtttgaggcactaaaagtgatatcccttcccccattccatgtcacagttttcccctaccagccgaaccatgttaaaagcaagtgtaattctcttcgccgcagcgtttccccgatcttatcacgcaacgaaaaagtaatttagcttggggtctttttgcttcgtcatttatgggtattccccctgtatgcacgtgtgccttatccgagatcaataggacacattcgtgatacttgcgttttctacagtcaagacagcggtacaagctgggtcgcagtttgggcctcacattcacgccttcctgattaaagtttttccgttcacgtggtactgtacacactgtaccgtcgtttcatagcaattgtcgttcaagctactgtaatttcaacctattgtaagaccccggaactatatgtggtcttacaactgttcgggggtcacttcgagtagctacgacattacattttgccgtcttctaccgtacattcgtgtgggctgtttgatgaaatggagctttagtgtgagtgcttagacgtgcacagcatggaaaagttccacagcagtgctgtataatacaccatcccataatatttctacgagctagttagtgatcgtcatttttcatgtcttggtataatatttcgacctcgtgggttgtttgcattcaggctgagatggtcggatacgagggcatgtgagacatcaagtaaaatactcttatcgagtcaacaaaatagttcataaatacataagaaaaatcaaaatctaccacactacaaatctcggagtcttcgtgcctcggatcaaaagttaatcaactgagaaaacagcgacggtatcgtttcacaggtttccggacaacagtccctcacagcccaccccacattgctggaccagtacatactgtacccacattctatcttggtcattacacccaagacatgcggacaaattacacttcctacacacacacttttaccccacacacaaaatgacaagagtagtggtgacaggacttggtctggtcagtcccctcggagtcggagtaaaacaggcatggaaccgacttattgctggaaaatctggaattgtggctctcgacgaacggttcgacgctttatcctgccgagtaggaggagtggtccctcaggacgaatggtctgaagcttcatctgccaacctcgcagctggagagatcaaacgggtacctctgtttgcccagtatgccatggtggctgcccaggaggctgtcaacgacagcaaattgctagctgacgcaggggagtcagctaaacacacagatattggatgttcgattggtactggaatcgccaacatggctgaactggcagatacagtcacagctttcaacaacaagggtccccgaggtatttcaccactatttgttccccgaatcattgctaacatgggtgcgggacacgtcagtatgcggttcggtctccaaggacccaatcactctgtatccactgcctgtgccactggagctcacagcataggagatgcagccaacttcattcgactgggatacgcgaaggctatgattgccggatcaaccgaggcctgtatgcacccaattgcacttggtggatttgcacgggccaagagtgtggctaccaagtggaacgactccccctctgaagcatccagaccctttgataaagatcgaggaggatttgttatgggcgagggatctgctgttcttgtcctagaggaatatgaacacgccgttgcccgtggtgctcccatttacgctgaagtgtgtggttacggtctttctggagatgctcatcacattactgcccctcctgatgatggaaacggggcctatcgagccatgaaacaggctctcaagcaggccaatgtttctgccgtcaagatcgattatgttaacgcccatgccacttccacccctcttggtgacgcggctgaaaatgctgctctgactcaactctttgagggcagaaacctgtctgatatcgccgtttcttccaccaagggtgccattggccatcttctgggtggagctggatctgtggaggctctgttcaccatcaaggctctcgaaactggagacttgcctcccactctcaacctcaatgagctttctgaccctgatgtcttcaagttcaactttgtgcccaaggagactcagcaccgtgatgtccggtatgcactcaacaacagtttcggattcggaggcaccaactccagtcttctttttggtaaggtatagcccccctgaaccaagacaatgtatatagttggctgtgttatatagcctattaacgaatatatccaatgacagcacaagatgcgtgtagcagtctataataatgtatttttacttccctctaccggattactctctctgtccggtgatccgtctctcgtgtagctctctcagagcagacacacctgaaaccacagccacaggtgtgatgagagagaccgctcccagcgtggtgaaaattgaggtctcgatgaagtaggacacaaaaacgagctcaaaggcgaccagagaacccaggaggccgatataacccagaggggcagccttgagagctccggatgcctggccaaggagggtagtagggccaatgagagcagtccaggcgaccagcagagcaccgaagatggccacggcaccagcggagaagatggtggcgacggatgcgttgacctgccgggcagcgggtcggaacacgtgcttgatctcgggcttagttgcgtgtcgcacagccttcttgtacttcttggattcctcggaagcctcaggggagattcgagcaacaacagtctcggatccctttgtgtcgaaagatcccagaattaccttaacgtcgaggggtcgttgggcagctaccagggcctgtgggagacgggagtgagggatggcaaacttggctcgtccgttgggtcgcacaagcacggggtaacttgcctccaggccactctcttcgtcggcaatgatcaccatgctctggtggggcacggcggatttgccattgtttgtggtgaagaagacaatgtcgaggctcgcctcaggaggcacaacggcatcaacagcctcgttggtgaatggcagggacacgagttcagtgccccgggcagacacggtgagtttcgcgtccttgatcgcccactcggcagcggccagtgccacagtcgacgcaattgcggccagtcgaagggggttcattgtgtgatgggtaggtcggtgttggtgaagatctcactattatgcgtcgtgatgacgtgtggtgagtgataaggttctggaagagtgatggtgaagcagcagcagaaaaaatctgatgaaatagacaggttttgaagaagaaagccctgattcacaattttaatgaagagatatttaatgtgttattggttgggatttttctctccgctttccagcgatatgtctgtgccaaatcgcgtcttactaatcacatctcaaattgactctcggaggatgcttgatgtaacctcgctgcgaccaaccaaaccacttgatcaaagttaaattagttgagacaatacacagcttcaaaagttagcttctcatcacacacaatccagttccgtgataccacaaccccaatactgaggctgtagcatcgaagggaggtgctatactactcgcattgttgacattatttacataccccgttactaattggctgaaattatacctattacataccgtgattcatggtgtacgtagcactccatctgggtgcaggaacacacagtcatgaaaactacgtacggtataagcggttagcgaagaaggcatgcgagctggcgatcagcgaggtcaaagcaggaaagtcagttggagaagccgctgtcagcgcttgtcgggtgctagaagattctcctttggtcaacgcaggatatggatctcagttggatattgatggagatgttgcttgtgatgccggatatatcgacactgactttgtcagaccagcgtgtgtctctggaataactcgatcacatcctatttcaacagctaaggcgctctcccagtcctataaagctccttcgctccctcttgaacgacacagaccggtccatatccatggtcaggagaacgtagagtcatatttgggcatagagggtgatgttgatcttaagagtccagaggctacaagggtgtgggaaaagtggaaaagattggaacagaatgcacaggttccttcctcagttccagaagatactgttggcgttattgttggtgacaaggaacatatggcgattgcaacttcttcaggaggtcccattttgaaaagcaaaggacgagtggggccagtagccacttatgggtgtggctttagcttacaaaaaggctcacgaaccataggtgtttgtaccactggttgcggagaagacattatcacctcgagattgagtgggcgggttttggaggcactcgctgaggcacaggaaccagatacagggatcagtgcattatttgacaagctacagggttcatttcagagcagccctgtgactctgggatgtctggccgtggtgtatgaggagggccatgtcagcatatacagtcttcacaaagcgccgtcaatgatttctgcggtaaaaagtggccatgataaaaccaacattcagtggttacaaaaggaccccaataccgtggttagctctatacagatatatagagagaggtgacagtctcttagggtctaatatatctaaaatatctattctctgtataatgttaggttgaacaatgtctaataatgttgaataagtgccttacgcaccgacgtcccctgattgtgttttttgttgttggtttttgttgtttggttaaaacagaccctcgatctggcccttggagtcgacctcgacgttcatatagccaggtctagtaggcagaccaggaatggtcataatgtcggcagccagagcatagaggtaaccagcaccaacagatgctcgcacgtctcgaatgggcacgacgaagtccttgggtacacccttgagggcagggtcgtgtgacagagagtactgggtcttggcaatgcagatgggaaggtttccaaagccctgggcagtgtaggtgtcaatcttctttcgagcgagaggcgacagctcaatgcctttggcaccgtacatctccttggcgatggtgttgagcttctcctcggcagaggtgtcgatatcgtaaaggaacttgaagttggggttcttctcgacgttgtcagtctggctacaaaccttgacgacacccttggcgagatcaatggctccctctccacccttttcccaatggttggagacaatggcctcggcggcaccagccttgagagcagcagttcggatggcctcaatctcggcaggagtatctgtggcgaattggttaatggcgacaacgacgggaacaccgaaagatcgggcgttctcaatttgcttgccgagattcttggcaccagcagtaaccaggtcaacgttctcgttctgatactcgggggcgagctgggcaccgggcttaacctcgggtcctccaccgtgcagcttgagggctcgaacagttgcgacaatgacaacggcgtcgggaacaagaccggagtctcggcacttgatattgaagaatctctctccacccatggtgaagtcgaaaccagcctcagtgaccacgtaaccgggctcgtcgccctttgtcttggtaccagccaacttgagagcaatcttatcggcgaggacagaagaagcaccaatggaaatgttggcgaaaggaccggcatgcacgaagacgggggttccctccagggtctgcatgaggttgggcttgatggcatccttcatcagggcagtgagagctccgccagctccaatgtcgtcacaagtgacgggaaggccctctcgagaagaggcaaccaccatgtttccaagtcgtcgtctcatatcggcgagagagttggacagagcgagaatagccatacactcagaggcgacagaaatgtcgaatccagtctctcgggttcggcctttttcgctggggccctctccaacggtgatacctcgcagaagtcgatcgttgcagtcgacaacccgcttccaggtgatggtctcaggatcgatgtcaagtcgaacaaacttgctgatttcctcatcagtcaggtcgttggggttagtcttgttgatgcccaacttctctagtcgctgcagctgcgagggaatgaactgtcgcttgcccttgacggagggaaccagccgcttgtaaagagcggcgtccttctgggacgactcgtggaacattcgggtgtcaatagcggcggccagcaggttggtggcagcagaaatggcgtgaatgtcaccagtcagatgcatgttgaactcgtccatgggaatgacctgggcgtatccgccaccggcagcaccacccttgataccaaaagtgggacccatggagggttgtcggacattagcaaaggctagcttgccgaggtgggcacacatggcctgaacaagaccaacggtggtggtagacttaccctctccaagaggagtgggggtgattccggccacaagaacgtacttaccgtcctttcggtccttgagtcggtccaaggttgtcagagagaccttacccttgtaagctccatagggctcaaactcgtgctcggtgagtccggcctccttggcaactgtcttgacgttcttggggatctgtgctcgagagatggcatcgtcagaaggaacgggcgttcgcagtttgagaggcaggggcttgacctgcatcttctgttgctcgagggactgtcgttttgcggcagtgaccacgttgttgaccagcatggccacggtcatgggacccactcctccgggaacgggagtaatgaaagaagcaacctccttggcagagtcaaagtcaacgtctccgacaagtcgctgaccggacttcttagtctcatccttgacgtagttgatgccaacatcgacaacgacagcgccgggcttgagccactcgcccttgacaaagttaggagctccaatggcagcaacaacgacatcggcgttcttgacaatggcaggaaggttctcggtgtatctatggcagacggtgacggtggcatcagcgcccttaaggagagaggcgacgggggtaccgacaatatcggatcggccaatgacaacggcattcttgcctcgcagctcaatgccagatcgatccagcatctccatgacacccttgggggtgcagggaacgaaggcggggtttccaccccgcttggaaagctctccaacgttgagggggccaaaaccatcaacgtccttggcagtgatgacagaatcggtgattcgggtctcgttgatgtgcttgggaagaggcagctggacaagaataccgtgaacggaaggatcgtcattcaggatgtccaattcctccagaaggtggtcctcggccatgtcctcggagaactttcgcagctcgcagtcaatctgggcctctcgagcagccttgagcttcatacgcacgtaggcactagagtcgggacgctcgccgacttgaattataatcagcttgggttggaaatggggtttcttagcctgaatctgcttgatctcgtcgtggagctctagtcgaatgtcctttgccatttgcttgccgtcaatgttggtggcagtggcatagtgacgaagagcagacaagctgagcgaatgggccactcgaaaagtgggaattcggccaggaagccgtcgaaccagacgcgacatggtcataagtagttggtgatagactagactggtggtgtagttggctaaaagatgactccagagaatattttcatactttaacctccacctaattaggttttggcacatcccccgatgtgtcactttctgttgtatctggcggaagttattttagagggtggccaaccaagaagagcatttagaagagcctatcacgtgaaatatcatgataaactggattttatcttgtcagtaatcaaagcctgcgattttaaccatcacattatctttcctaactaccagactcggcgcctgttccacctctgcaccgactgatacttgtacatatactgcaccacaatatgtacatgacatacgaagcctatttttttcgaaatcgggctacatcacgaactaccgtagaccaatttggcaccacaccctgtcaacaagaggtatgcaaacaacgacgggattatgttatcctcggtgatatttgttaagatagtcatccccagggctactctcactatggctataaactgatgttgaattgggcgaaacgatgacttcctttgagttgcagggtgacgctgactgacctagatctcatggcacccactatgacacgaatgtagataaacaggatcgtcttcgaggcagaggccatcaaacctcgatattgtaatcgttaataccatcaggggtcaatcaaacagaaatattctgtataaacactccctaacccctgatctctactcatctattgcctcgtcttgtctttggatcctgcatgactcaataaaaagcgtagcctacccgcaatattttttttgaagttgaagttggccggaaaaaccgttgggaaggttgttccggtctcagaagttcacatagacgctaacggcaggcgtcggcgaaaccaactactgtacaagtacagtaccgtgccgcccatgagtggtctgtaaaaaaatattgcagcggttgtgagcgttctgtctccacaactaacacaggtcgcatgttgtggccgaggtcatcgcagtgcacatcctgtgccagactctgacctgacctgagtaaaaaaccacagcgccgagtaacgaaaatagaccgggtccggtttggtccaaaatagtaattctgggttggggctgcgacaaggtcgctggctgcgaaccttggtgcttaagcgaattgactaagcagtgactttacgcgttgcagtgcatattatacggtgccctacaggcaggtttcattgggtaactacacgcgtgcctagacatggtcccgccgtggaaaatcaaatgtaaaacatgtaagaacttggggttggtttcaagtatgtacagtaaagtgtactgtacgggaatttgacgttggaatgttacattgagtctcacgagggtgctgtgttagtagcatctaacgggagctacaggatccccgcaaattagaagcatccaagaacaaatttatacctcactggatattgagggggtcacaagatggcacctcctctccacacacccgtccagtttttagttagctgtagcggttttggagcattgaacgagggtctagcctcgatcctcgcatgataatacttgtaggcagtactcgtacagtagactgtctactggtagctacgaaggaggcaagcctgatactgtgttgggctcacagtaagacctctatctacgtacactgtagctttcggagggtcgcacgactgttgctctcgtcaggtgttacaatcaatattaatagccgtgattttaaggcaggaacaatgtcacattctgacgtggagaagtcgcctccagcatgttacaatatgggaacgctttgttcaacatagcacgatcatgccacggaaaaatgtatcagtctatattttgcgtcacacaaggaggtgttactcaatgcggctttccttgatgacagttttattgcgcttgtaggaggtgatgagaagccagccggcaagcaggttgaaccagtgatggatcatgaaggcatgcatcatgccgtatgcagtacagttgaaacacgcgtatccgaggatgatgtatgtgacgaaggggaggccacgttcaggcattcgtcggaaggacaagttctcaatgaacaacaaagtaggaagaacggaaagaaggttgtggtgagaggaaaatatggtggatcgtccaaaaaccataccttggacccaaacagccaacacggggatgttgactagagtggtccaaaccatgaccacagacatggttgtggcgtaattaatgaaagacccaaccttctcttgggcttgtctgttggcatagagagatgtggagaggtcgtgcgatgcagaggccgactcctcagcgtcaaagtaagcagtcagtgccaacagagaggcggttgccagcgcaaatgcgagctggtaaggcacaaaaagcagcaccagcaaggccatgagtgcgatgatgacggttcgtttgtggagtaggtccccaataggatcgtcagagctctgaatcgtcacgttcttgggagtctgaagtaacgacatcttgcgatgtcctctcgagatggccaacgatgcgagggtggtgacggcaatgacgatctcggtaacaactacgactataccagtcgcaagtgccagaaaagcgggggctagaacaactccgataggcccgctgatacccaaaaacagatcaatatgcgtgtagagtgatccatagaaggtttcgatttcatagctcttactagaacctgtggcagggatctgaataaagtgcagaaagtctctgatgaactcgaatttgatcacgaaactgagaccggccacaacgagacatgcccaggaaaggtactgcttgatgaagagcccggtagcatctcgcaaggagagaaacttggcatctgatccagactgatagtatctccaaaactgcaacagaagaactgcatacagaactgctgtggggagtgagaacaggagtgttctgtatcgcataaataggttgcctagggacccaacatagtcaacagaaattgtaactttaccctgtccaaacacttggagatggagtggggccttatacgattttgtggacaggtctgtttttgttggcgtcttaagcttaaacggcacaaacggcgctccatcgccatggaaggagatgtccacccgagcataatgagggataaggtacttcgaatcataggttcggctagggtggtttcgacccatatattgtctgataagcccaacacctcctgaagtaagcaccttgtaggaaatcaagccagatgtaagggctgggaaggcaatatcctgagataccatgttggaagtagagaagacgatgttgccgtatatattaaaaggagcagctgacatagacgtttcatcaatgttgatccagtctccagactcgctagcctccttggacacatccaacaagagaataccgttcacggatacatgtgagagaacggaatcattaatccccggaacaaaaagggggtagattctcttgcattgtcgaaaagaagatccctgtcttgatctacactgccatactttcagtagacttccagattttcgctcgtacaggtcgatattggagtcgtagttgatgacatggttagtcagcatctgaaggttacggccccagtagaagcctggggccagtctttgctccactccatcctgtagaggtgtcgcctcaatgttgataaaatcctgcatagcgctagacagagactgcgaacctgagaagcttctgtggaaagtagacattcggacttcccgaggtttcgtctggcttgggacatttggatcaacaatgtgaaacagtgctgacgcaatttgacgtcggagctggtgacaccacatgacggcatcgtggtcaattccagtccaaactcttgcaatggaattcgtgaaagttgaaagaccatttgtggcaggaaccagtgagtctagagacacatagtcggatggtaccatggtatcactcttgcctccagcaatagacagaatggtgatatctcggagagggttatcgttggtatctccttcagcaaatgccgctctccaatagtcgttgactagatggtacaccttggtgatatcagcgtcaaaggtggcagctgggatgagatgaggtgacgccagcgtaataatagtgttgacactctggggtcggtagttctccaaagtaaccgcaacacgtgacacaattcctcccatagagtgtcccagcacaatgactgattcgggaacctgtagtccttcttgttggttacgcttgtacatgtctaagatgtatgcaatggcgtcgttgagatactcggcctggtcaagcagggtacggccatgcaaagcagagtatgcctcgttgaagtcgatagagaagaagtcgaattctgttcctgcgtcccctttggttagtagtctgagttcatcgttgagttcttgggcgatgccagcgaaagggccgatctggcgaaaccctccagcgttgccgtggacgaaaatgacgggcactcctgacggtcgaatgggctgagggatggcatgctgagacgctcgaatcaagtgtagtgagtatttttcaccaaaccgcgagtgcttggagtcgaaaccttcaacatgagcggtcgagatccaagtgcgcgctatatcgcatgtctggacgtcgggctggtgtaatgcgaacgagatccatatcgtcaggatggtgaacacggtccacaatgccacgctagcattgatattgatccgtcgcatggatgtgcagttcgcaggtgtacagcggagagtgggatgtcggttcctgtttgttgtttgatgcaagtcatattcttgggtctcatgtcaatctgtctgggaggattatgtaagcctttattcttgaagagaacgtcacttcataatgtgtcaacaacccaatacagggtgcaccgagcagtagtcaaataaaaaggtgggtgtcactgccaaatatacacgtgtaggcccctgcgtatcgtgccaggcacatatgatactacgacaaatttaagatggtgttcctgtacagcctgtcaatcgtgtggtgggcacagcttgtgggacccccctgacatatatctccggttataaccaaaaatacgacgattatctttctcctactgtatgtactgaaccatgtgtttttgctataaagcactatcgcagtttgaatttgttcttgattgaactgggggtctcttttgttactgtcgctacctgtaaaagaaccgtaacaactctctcggcgccacttggacctgcacaactaaaaatattgaagataatcaacatggcatatgtgacggcgcgccgcaattggctgcaaagctagattctgacgtatcccttggcccctatagcttgcctttcgggatctctatcgatcctcctctacttgcacagtcgcaggtgcctcaaccgttagcttttcacattctcatgcccagaaccctcctccgggctatgctccttctttcaggcgtagttccgttatcgatgaagcacacctctcaggcgtgtgttgacacgtgtgacaagatatttgacttccagtctgatattttgttgatttttttcaagttactggaaccagtttcactgatttaggcctttttatacacaaccaggttccagcccagtggaggagagcggtgctatgatgttactggtataataacagccaatttaaattcgtcttgctctctttgttaaagctgcaaatgtggggacgtgtgcggcccacacccaaaactacagcttggatgcaccgagatgcattttcaacgcaggtatcctttgcgtttcatcaacaatctggcggggcagtgcgggtgtggaaagcaagcaaccagaagagagagccgtggatgggggtcgaaaggagtatatatacaaaccaaattccccccgttccttagcgcgccttttcgttctaggctagcttatccacaccaccaccacacacacataatccgcaccacacaaactgtcatcttcttgggacgttgtattacacttcgttgtattatacaacccaatccacccacacttatttccccgccgatcaaatccagtcgtgtctcagctttacccctctgtcgacgacattggcatccttgacaagagctgataaacctctagcactccaacaccacagctctccagcactcgccgtcactcccttcgacctccaagtcgccgtgcccccatcccacccgctaattcgaaacactacccccgaaacacaaagagctaaagtcaagaactcacttccaacagctggtttcatccacagaccacaaaaacacacatacccacgcacgccaattactctcccacgatctctaaaactatcataatgcatcgacggagcagatccagtgtcgccagccccgtctctacctcagcgtcggctgccgtggctgtgccactagcctcgtcctccagacgaaactccgtcagcacccccttggtttcaggggctaccgtgccctcctctggagttgacatgttgaccatggagactgaacaggaggccatcttcaacaaattgcagcgagaaatcaactatctgaaggacagacgaggctctggaacggatggccagagcgtcagtcacttcagaaaggcctctctctcaggcgggcctgaagagtacggggtttcaccaaccagcacagcgtccgtattttcggcctataatattcccaactcggtgtcgtcatcgtcgctgtcgtcagtatccagcacagtgtcttaccaggaccagggacgccagtttgagcgcagagggtccattcgaagagcatctgtgtgtggagaggattacgaaaaactaaagcaggagaatgaaatgctgaaaaacaaactgagagacctgacattgaagctcgcagataaagaacatgaagttgagcttctcaagtccagaggtacacctcccattccagtcaagcttgtttgagacgacatgtatgctgccatagaaaaggagtgagattagaacacccgtgacgaacataagtaaacaacaataaatatatgtgcaagtatcacacagctgcggtaatcactggttgttacatgccacgcacaagtatcttactgatgttgttcatgaaatcgttagtttatctattctatctttataatacacctctaagcatttccagcgatgttgccactggtccaagtgaggttccactgatcgccatataggcttttgacattgtcgaacatttcctgatctgagacagactcactttttgctagccagtagttatccaaagccgcctgaagttcctcgacagttgagacgccaaccacggtgcctccagggaacttcgcaaatgcataacgaagagccagatcggcaagctcgacatcctggctcttggtgtactccacaaccttgctgacagccttgttgagggactcaggtgcagggtggaacgaatgagtgggctgggatctcagaagtgacatggacagaggagatccgttgagcactttctgcacaccggccagcttgaatctgtccaggctttcgaggagaagagtgttttgaaggcacatattggagtagctgaggacaatgtccactggcactccctgatctcgcagaatctcacacatgctggccaggaagtcgacagggtacccactgattccgacatagtggatctttccctcctttcgcatctcgtgcagagtggtgacagcctcgagaatctcctcaggcttcttgaactcgacatcatgaacgtaaaccacgtcagcgtaagtagtatgaagcacatcaagggatcgctcaacgctagctctaataccttccttggtgtagtcgaataaatcctgggaaactcttccagcctttgtacaaatgtagtagctctctctaggccacttttccttcagtttgtccaggacaccgcccagaatcacctcgctgggtccgtagtaagccgaggtgtcgatagcgctcatccccttggagaatgcttcgtccaccatggcagtggccggaatgttctcgggatctgacttgtagatgtagttgaagacggcgcctccaagaatcaggtccggcagacctgccagggttccatctacctttgtggggagtcgtttctcgctgagcgtgatagtcatctgggtgtgctgacttgtgatgtgtgtaatgtgcgtgcaacggcgtcgaacttttcagacacgcttgtgttaatctgataactctgcagcttatctgcactggtacgccgttgtgaacagacagtaagacaacagcgactggttttgtggcttgtgccaagatatttaaagggggaggaggttggacacgtgacttggcataaccacacagcctcgcttttcatgtgacaatattcgtaatcagcgttatttattgaccatctgttctcccactcgacttactaaatccatatcactttattaccaatgccacacatggttagggttttttagtatatttgccacatcactctaaaagcttgcgagcatgaaaatcgcagtgacctgaaaccactgtccacgccgtccatgacaacatagatacggagcgccaaatgatgtgatgacgaaatgaatagtttaatgggcatcccagtagaaaatatgataaattatagcggtattgttcaaatcttctttagtctgcccagttctacttaattgacgagtttagttaacctttcaagaattgtccattaaactgtactcccaacattcaatgtctgcattaccttgtgggtcaaccgaatataatagtttgtgtgatttaactctccctcttcccctctccttctctcttcctcgtcgacagtcatacgcttcaaccactccatgatagataatggtagatacctttgctgatacccccttgagatgcgatacaccgctctcatcccccatctccccaactaacacagatctggagggcgctgtttctattcgtcttgcccgtagccacacaggccaacttcacggtaaaggacttgttgcaacacaaagacaacgaatggtgggctccctgttccgcgcagggcggtacccttgattctcagcagtccataatggccgccgaacccttccccccgtggttgacggctttcacaggcctgacagcttggcctcaagacaatcccccttacatcccgttggactacgttgatctcgcgaccgttccgaatcacattgctaagcgtgaacttggtatctgtgacggagtcgagcgcaccgcctgctccttcgactgccatttgtgtattgctttcgacgacatccgcacttgcaacaagatatcccaaacatttgacgacgggcccagccctagcacaccaaaacttctggaaatgcttccctcaaaaacaaccttctttgtccagggcgtcaatgtcgtccgcttcccagagatcttcagggagcaataccgccagggccatctgttggccagtcacacctggtctcacccaaacctcgcctcgcttagcaatgaagagatagtcgcacaactacaatggactaactgggctatgaacgccactgccggtatcatcccacgctacttccgtcccccctatggcgctatcgacaaccgtgtacgtgctattgtacggatgctgggcatgcagtctgtgttgtgggaccgagacacatttgattggaaggttaacgccggtattaagacctcccctgaggtcgtggaagaggtccaagactggaaactgcagggtggaggctggggtttgatcctcgagcacgatactaccatcaagactgtcaacgttggacttgatgttgccaaagctcttgggccgaaccagcttaccgttgccgagtgcgtgggtcagacacaatggtaccaggatccagcacggttgggtaacgagccccgccgtggccaccgagcagcttcgtaccaaaggagttgacattgttgaccccattgctgtataaaaatagtgcgtaagtatgtaaagcgaatatagcaatcattacaattacagagactacaagttcttgtagtgaagatataccggtagatgttggcggatgtcgctatcacaggataattaagacacgttgtctattaatttctatagttgcggtaatatattgcattgtccccatctaaccaatcgcagcccagaatctttcttcctctccatccttgaactccagcaaagtagacattactggcagtaaattctgtctctgctccttgtgctccagaaatccgagcagcacgttcttgatgtacgcagtgttagtagcagtagcaggagcgggaggttgtgaagtgttagatgccacagaagatcgtcgtgactgggcaggtgacgtcacatgacgctgggagctactgatctggttgccctccagtctgtgcttctctgtctgaagagcgatgatgtcctcgttgagaattttctgctgcttctgcagcttgtcgtttcgctgttgagcatcgtcgacggcctgcttcagacgcagcactgtggcctcggattcgctgagacgtccatccatgaccttacgctcggtctgaagcttctggatgaccccattggcttcttccatatcctcctgggcactcttggactccttatcagcatactctcgagacgacttgagtgcctggaggtctctgagagctcgctctttgtcagctcgcagctcctcggcgtcatgttgaagctctcgagtcttcgttcgggcctcctcaagctcacgctgtcgacgtctagacgattgagcagcactggcttccagttgatccttctcgtcagtgagagctcgaatctgctcctggagatctcgaatcttggtctcactaccgtcctcggtctcgttgagaagacgtcgcatggttgtggtctctcgagttcgctcctgcagcagcttgtgtgcatcggagacttcatcctccagagactcgcaacgagaagttacctctctcattcgcatagcaacttcctccaactggctcttgagctcggtgacctcaccaagggcatggtccttctgagcctccttaatcttggcctcgttgttggcctcagtcagctccttctcaagagcagccttttctcgggtccacttggaaatggactcggaagatgcagaatgctccttctcgagttgctcgacacgtgtagcaagagcatccttctcggcgacagcatccttcttctccttctccagtcgagcctgggtggtcttgagagtagtaatgcggctctcgatcttgttgcaccgcagatctgcctccttgtacttcgcctcccagtcggatgaagatgcagtaacagcagcaagatctttcttgagcttggtttcggcagcaaccaacttctcaagctcagcagtctgcttagccaaagtggtctcggcgtccttggcaatcttcagctctgccttgacagatcctagctgctcctccagctttgaaagctgctccttggtggtgccgagctccttgaatcggtcctgactgagcttggcagagtgggcgtgagagtcctcggcggcagaaagatgctgctcagtggtctcgagcttcttcttcagctcctcaacctcctccttgacagtcttgagctcctcagtggtcttctcagcctcagcaagtctgctcttcgtagttttcagctctttcttcaaagattcaagttcctcggtcatagcttgggacgaatcctgggactccttggcactagcgagatccttcttgagagactcaatctccttcttgagagtggcaacctcatcctcaaaggtcttgcccttcgtcagtgcagcagtcagctctttgtttgtcttgtcaagatcagccttggctgattccaaagactttgcatcctcagaagactttgaagactgggtcttgagctcatcaacctccttttgaagcttagaatgggttttgtttcgatcctcgatctccttcttgagctcagctacatccttctgacgctcctcaatctcttcctccttctcggtgagcttcttctgcaccttctcgagttcatccttgacttcgctgtttttattagacttctgagcctcgacaagatcgtttccaatctccttgagctggtcccgtagactctccacctcggacttttcattagcaaggtccttctcaagcttttgcttggcatcctccagcaccttgatctgagcattgttatcgggtgcaggggatcctcccttcttgcccttctttcccttaccaccagtggcaccgggagaggtattggcagcagcaacagcagacgcagctgcggccttgaccgtcgcaagctcgctctccagatcctccttggccttgttagcttcaccaagcttcttctggaaaccctccagcagcttcgatttgcctgccagatcattggaagtcttatcagcattggatttggcctcggcaagttcggtcttaagcttttccagctcagcagagttgtcaggagtcttctcaatctcagccagcttctcctggagctcagcatcagccttagaggcggcagacttggcgtcagcaagctcctttcgtgcagtctctagctcctctgacacagtcttggacttctccagctgttccttcaagttattgatttcgccaagatgcttttccgatgcagccttgctttcgtccttgatcttgttcaatgtttttgtgagactctcaagttcggagtccttgctggctgtagagcggtcagctttgtctgatgcctccttagccttgtcctcagccgctttgaccatctcctcggcggatttgatcttatcttcggccttcttggcctcacccttagcctcgtccagctgcttttcaagctcctttaccttctcctcctgagccttgacattgtccagctcacccaccctggtcttgaggccatctaacttggtctgcagttcggccaattttgcatccttaagctccagctcagcacgggtttcgctggttgtgtcggtggcctttgattctgccggctcagcctcctttagcttggtgttctcagcttccagatccttcagatcagatgtgagtcgagccacgtcgctttcgagcttctcaatggtgtcctgatcctttctcttggtgccgtcgacctccttcttgagtgtgtcgaccttcgtagacaatgaacgaagctcgttactctgcatttcgctcttaagattgaggttctcaagatactcaacgagagcctgaggttcattgagaccggagcatggagttcgctcctggagaacacgctcgaaatcctccaccatgctctttaccagttcggacttcttcttctccactctgtaggctttgagaagatcggggtacttggcctcataccgctggaactttcgcaggtgagatttgaccttgtcaggcaccggaagagtgtcaatgatgtactcttctggctccgtttgcgatactggctcggcctcggtagctccaccttcggtggagggagctgacgacccattgtcatctagctccatgcgttccacgtctggagtcttgtagctcatgagctttttcttgcgctcttctgcctcgtgttgctgcgccgccacctgttggttctgggcgtttttcacggcgccatctagttcatccgtgaactgtttaacgctctgctggattctcgagaacatgacgtggaggtattaggttctacgagtcgaagatgtaacgagtgcataaaagtcgatgcacaagctacagagagtgcttgggagatgaaggcgagccgagccatgagagcatctcaaaagcagagcggaaatgacgaaaatatggtccgtttgcattgtattttttgtcagtctcaattgaatatctgtttgatttttccttaccttttcactcctagttatgacatgtctcaccaccttccgtccccccctgtaaattaatcagctttttagattatgagtggcacaatgtgctgacaaacgatgcgtgaaattaggtttgttcatatagatcaactccgcgtttgtatgacattctcgccacttttcataccgccctgatgtcatttactgtgagtaaaaagcgaacagaaaccggaactgggaacctcatccgactctttttccagtgctataaatttcactactaacgccagactacatttgctgtccctttggaatgtgagtcctgctgtgattccgtcaagcaggcacttgcaaacgtccagggcatcgagtccgttgactgcaagctcgtggatcagcttatcagtgtcactggaacttctgctccgtcccagattgtaaaggccgtccaaaacatcggcaaggacgccattgttcgaggcactggacagcccaactcggcagccgtctgcattctcgaaagccacgcccccgaagaccaggcccaacctataaagggccttgcccgaatcgtcagtgtctccaagacccttgcgctcatcgatatcaccctcaacggtcttcccaagggcacatactaccccagcatccgtaccagtggagacatctctgatgcgcctcagagtctaggaggcgtataccaggcgctgggcagcgtggaggtgaacgagtctgacagtgcatctggactcttttccggccaagcatttgtcaagtccgagacccagatctccagtcttattggccggggcatggctgtttctacaagcccagacgttgtcaagcctcacgctctggtgggtgtgattgcacgaagcgctggcgtgtgggagaatgataagactgtgtgttcctgcagcggaaagacagtttgggaggagcgaaaggacgtccagagtaagggactcgagggccagctctaagtgtccccttctattattataattgatcaatcgcattttcaaattcatttcatttatttgggaagctcaacgccagccttagccagaacctcagagagcttcttgtcgtggaaaagttccatgacctcctctccagatccaatgtgcttgcccttgacgaagactgatgggatggcgttactggaggtgatctcgacaaaagccttctgcagctccacacggtccatggcttcctccttgtccaactccaggtagaagggctccaactcgcccttgatggtctggaggcaagtcttaatttcctcacacgcatccgaccaagacagcgccactaccagcaccttgtgctcgtcaattaggcgctgggccttctccaggtacttctggtagacctcaatgtagagctcgtcgtcgtggttgtccttgttgttgtttttgtggtgagtcattttagaagaaaagattgtaacaagagtcggtgattagttttgagtgttatttgagtgcgtggaggtcgcacctccacagtgtttcgattgctatgcggctcataattgcttatgcgggcgtgataaggacagcccaaacaagcatgtacttgtagttaagggttggtgtttgtgcttcgtactgtaggcaatgcaaggcaaagggagggtgcgcgagaaagaggccataaaacggcagactgaaataacacgaggtcgacggaaccgtccggcatcggcgtcttcagaaaatttacacacctgtcgccctcacgtaaatttcctagtttccgtattaaacgtttcggacgggtctcatgagcttagtgcgcgattatatgccaagcactgtaaccgttgtaccagtgacagcccatcaacatgacgtctcgaagatcacctgctgtggatagaaactgcgtggagaaactcgggcttgaacagctgcaagcaaggtgtttatttgtgtccaacaagagtcaaaccacatatatataaaggagttagcactactgtatttatatccaatatgtaccgcatcagtgcatctcggctaaaatagacgagtggtcttgttgagatatatcatggtgtccacgggaggggctctccaagtcgaaatgctctctacttgtaagtcgaaaggcatcggtgggaattttttctccggagcgggattccgctcatgcttacagaacactcttagcattcgactatgtaagtacctctgcacaggagaccggctcaactctgcgttggcccgctagtcataacttccgtatgccgttgaatctcagagtcagaagagcgcaaggttcgggttctaagcaaggactctaccagcagagagaggtgaagatgagggtcagaaactttctttggggtggaggggaagaagttgcctctagatggtaagacaccacacagggacccggataacggcgttaaattggaacgacatcgtgaaaaatagccagtgagcggctaaaggatatcaaaatcagctcttttagtgcctgttacgctcccctctagattgcagatgcggcagtgtcttagcataaattaaactctgaactacaagtacagtatgtagtaataatttatatcagtactctcatccaggaacgcgaacataacatactccacatcttgacctagcaccacaacaccagctacacgctgctagccacgctacacatcacccaaccctgcccatgcaacgaggtcgccagagacgcgaagagtcggaagactatggagcagaggccatctccaacaaccctggcctgcgccacctgactgtaggacatgctgcgggtcacagccacccgtcctctcacagcagtagtcaaagccccacaaccccttcatttgagctatcacccccgccaccagaagaaagcagcagcgccgacaaacaggtccgcatagccgacgaagagccgaatctggagcttgtcaaccgacgtctggcagagagaagaggaagaacacgaaacgaaagtagaagccgcagcagaagccgcagaggatcacgcagtggagagcgagttccacgccaacggtcgtcgttacacctcggcgatctgaacgtctccatgcctatttcgacaggctcttatggatttagaccacactctccgtttttgaccccacagggtctcagtggaagaagtagacctgtcagcagatctggtagtcccactcgtacaccagcctttacaccgggacattcacgccacggatcgcgcgtcaacataaaaactgtgaactccacacccaacatgagtcgttctgcctcttcagcccgaatccagcggatcggatcggactacttccagacattatccacgcgaatgaagcgaatggatcacacaaccgcccatactgaagactcggagcttttggagacatacggactggaagaactacgagaaggatactttgatgccatcttcgagccggcaagaaaagcggaggaaaacgccagaatggttgtgcttcaaatgagggagaaggcacaggcagaggctaaccaggtaaagtcgcctattcagctattcctgggcatgttcgtgtccacctaccacgccattagaaccactctgcttaccaagaatggtatcacggtcctgaaggcgttcttggcctactttgtgggctttctactttgcattattcaccccacagcgcgttggcttggtccgcactgctattttctgccaatagccaccatcctacaccatccaggacgtcgcacgggatcacagatcgaaatcaccgttcaatgtattgttggccaggctcttggaatgggtattggagctcttgcgctgtacgttagtgactccactacgacggcaagaaaaggacatggtggacttttggcagtggctgtcattccaactattgccgttgtttcttggatgagagcctgctacattcgtctctaccacgggttcctgtcaatgggtattgctttgcttgccatgacagacattgatgtgagttcagacttccactggcgaagtgcatgggacttcggtattccttatttatttggcatgctcttgccagttgtgatcaaccttttgatcatcccctcgattggtcaaggtgatatggtcacttgtatggctgacgcgttgagttgctgtcgagactgtgtgcacaaaatgatggccacggaacctggtgtcggtaaagaagcccaagatgctctcaatgctcagtccatcgctctgtctgacattcaccgaaacatgtgcaacgaaatcatgttgaccactttctccaaggacaatgtgcgaatcgtccgaaacctcatccaaaccgtcatcggtcatattcgaattgttgacttaccctgtgagatcttcagtgttaacgttgctgccgctaaggaggacgcagaagaggactacttcaaccagcacccgcatcacgctattcccgacatggctcccaagatttttgagctgttccaggaaggagcacgtgatctcgttctttctatcatggaagccctcactttggcggaagagttcatcaagaacatccgacatccaccggaggagatttctctcaagtttcagaaggccatgacaaatctacagcacaagatgaaccaccttgatgcccagtataccaagcttattgtggaccaacaagagttgaacatatctcgacgagcagctatcaacgctctgtttgttcagcgactgtctcactgtggccatgctgtgttcaatctgctgcgtcacttgcatggcatgtccctagaaacacctcactggcgtctctcgttaccccgatacccctggaagcgagccctcacctggtccaatacccaatctttgcatgaccgaggtggaaagacagctggtcattactttcgtgtcaaagccgaagttgaagagatcttccatcgaacattcaacatgaatacttctcgtcatattgtccgagaaggagagaagaaccagaagcagcaaatgtgtgtcaatgctgttgatcattccgactttgatgctaagcatggtgacatttcgtctgctcgttacaagctgtggaagattcttcatagactccagcgatttgagagtaagtttgctgtgaagactactattgctgtgactcttctctctcttcctggctggctggaaggtcatgactggtaccagcactacgacgccttctgggctccgatcctggtgctcatttcgctgcatcctcgagctggtggtaacgcccatgatctgattgtgcgaactgtggttgctattattggtgctgtgtttggtgcccttgccgctggaatctggcagggtcacaaggccagtccatatattatgggtgtcttctgtgctgtctttatgataccttgtctctaccgtttcacagtatccaatcatcctcgctccggtctcatgggttgcttgtcttttacaatagtcgccttgggtatctacaccgataaactgcagggacctaagcgatggcgagatgcaaacccagtcacgggtacctggacccgtgctcttggcattctgatcggtctgtggtccgccatcctcatctcttggatcttatggccctttgtggctcgtaccgagtctcgtgtcttcactgccgatatgctgggtcatgtttcgcagtgttaccagattgtggctgatcgatacctataccatgatctcgacgatgatcctacaacgctggccattgagctctctcagattcgagaggcacgtatgagacagggttttcaggcttatcgtgagctcattctgtcgacccgccatgagccttctctcagaggtgatttccctatccagacgtacctggcgctgtttcaatcttgtgagcatgtgttcaaccgtattgtcgaggcgcgtatctcatcggtatacttccgaatctatgagttcgacgaaaccaaggagacgactgctcacctgctttcttatcgacgagacgctattgctgctaccatcatggtcctgttcatcattgcagactgctatagagctcgtagaccagttcctcggtacctcccgtcctccaaaatggctcgtaagcgactgtttcagaccattgcttctctggagaccattatgttggatgagtctgacaatgagacacatgttcaggaccatgagaaggacgcccagaagatggcttcgattctggcaggatctcgaaaggttggcgagcagcctgttttccaaaacccctttggaaaaacagacgaatctggagagaaggagaagactgaggatgacgtctcatctccattggctggtccccttcatggcgactcggtcactgaacgaaagagaaaattctggactattattcacgagtctgcttttgcgactgcttttacagacatttcggaagagctcgagaagatcgtcggcttttccaaatctgctttgggcgaggagacctaaacgctttcaataacctacacgtcaccccaaaacatatctatctatacatttaataatatttgaattgcatgacttcatgacccgtaatatatccatttcccatttttgtttataatctctagttgggtttctgtgttagatgagttccatcgattctcgtgctgagttggtgttgagtttaaggtgggtaaacgacggacctttgggtggaaccaaatgggatatatttgtgcccctgtatactcttatggcaaggtaaacacgccggctatgtcgttttgttgatgacacgcgtcatttcggtggtagtgtggacgatgtcaacattgatgatacatgtgatgtggtcacaagttgagaagagatgcaaagttttatagtagcactcgcagatccacttgaatcatcacacagtctcgtcgtattcccatcacctccaaaaacagacccatagacatctttcaagcccatcatcgacatgcatgtctctctaccaccttctcaattactcacagtagtcacattgacgttgaaaaggtggaacaggaaaatgagaccaatggtcagaagaccaagcgtaattgccagaatgtagagctggtcgtcggtgatcatttcgtggtggtggtttagtaggaccctttctgatgttggctctgacactcttagagttcagtctgacgtgggctttggcgtcacgtggaacatgcaggctgcatatcatcaatgggacacctcgattttttagccatggaaaggcagcttctatcctacaaactacccctattccgcagaacatttgccatcatgtcccgatccatacaggagtcgttctcgctcttgaaccagcgagaaaaggaccgactgaaacgagtcagccaaaaagaggggctcgccaatccagaccgcaacagatacagcaatattataccatgggatcacacgcgaatcaagctccgcactagcaaggatggtaacaactatatcaatgccaacagagtgaccttggtggcaaaaaagaacaccaaaacctaccacaagacttacatagccacccagggaccgttacgacagactgcaggtcacttttggcagatggtgcatgacacaacgacggaacagggacaggagagtgacaagccaactgtggtgatccaggtgacccccttcgaagacaaccacggcgagagatgctgtcagtactacatttcgcggaagggccaagttttcgaggtggatggagaaggagatgtgcttacggtggaagttaaagataacagcgaagtgggccccacgaaggtgactgaatttctggtaacaaaagggtcaactggaaaggttaagagggttgttcattattactatcctaactgggcggacttttccgctcctggagtcaacactgatattgacgatatagtcaagtcagcgggtcctatcacagatagcccgcccatcgtccactgttcagctggtgtcggaagaacaggtacttacattgtggctgattttttgaccactttccaaaaagaacttcagggtgaggatattgtatgtagcctggttgatcagatgagacaacagcgaagccatatggtccagactatctctcagtacgagtatcttcactccctacagactgaacttctgcattgacatgttgtgtgtattatagaccccgtacataaatgttattaatatatagactgcatttgaagctattcgagttagtactctagctgtggctctctggtgcgtctgcaatacaagacgaagggctcttcttcaagtgcccttagtctaatattggcagcgttcatatcttctctgtgttttctcaaagcgtcttccaatgcagctaatcggttggtttgctgggtttcgtcatgattctttggcacaccagacttgtccatcttctgaagaggagcataactatccatgatgatacggcccatctgagccttgagttctttgatgtttacttgttgtcggtttggtggaggatgtcgatgaggtgcgtcgactggtgcatgaacctcatttgaaagatcgggaactcgaaattccgcctgcttccaagctctctcgcgtctcttggcgtcgtcgtccttgaagtcgacgtacacatcctgagaccatccttgtcggtgcggggaacgactcatgcgatcggcaatgttgactgaaaacaagtcttcgtaatggcatctcgcagtcttgggttctgcgtttgatttctgaccagaaacggttgaggtgaaggagtgtgctgtagcgtcagctcttggagaagtcttccttctgcctcgtagcaatctttcattctccctctccaggtcagcaatgtcgccctctaggtccttctgttgtttgataatgtctttgatctgctgctcaagtctggctgcctcagtgttcgacgcctctagtttactttgtgcagcttcaatgctggagaagatctcctggtcaacctcatccgtgttgataccgatgatatgggtctttcgcttgggcttgatacgttttcgataactgaaagaggtggtgtcttgttgggtgtattttgtgtcctccgtatattccatctgtgctttgacaagctacaatatacctgggcctcctccttaaaatatggtgttcttggacagccatgacacagtgaactaatcagtcttgggcatagtgacgaaacaccaagggtattattgataagtatcatgtgaactcactatgatgcaatgataagacacatgttgtgttcgactggtaccaaaacgcactcaagcaatcctctaatatctcagataatacttctgacctgattgagttcaattccctgcaccaagggtcctaagcgagccaataactctatcttggaccaactccttgttcgaggaagatctatgtacgagtacttggtacagtttgtgctcgtaccgtatgtacagtatgtacgatacatacgtacacaaagtgcaaacccatgtcactcaagctacttgtactatgaaattgtacaaatactgccaaaaaatatatacaaggcaagttttattgtccataagttataatttcattcaactacaacgctaacacactaaagctttgcttcaaccgtttaaagcttggatcgaggagatcgctgaagagtagcgtctcggacgagcttaccgaagtgagcatcgaccttgtcgaacatgccaaaggtcttgtcctggacctcgggtcgagcaccggacagagagacagcgatgttgtaaacaaggtgttcctgctggtctggggtctttccaagaaccttccagagctcagcgggctgctggaagtcaacaccgtcggtgccgacaacccactggtaggcgacggcctcaccaacccacttctcgtgcttctcatgcaggttgatgtcctgtcggtactgcaggggctcgaaagaagaggggtagttgggcagagagccggagttgccgttaacagccatctgaccatctcggtggtaaggagtatgggcatggtagggacagttgacggggatctgggcgaagttggtaccgagtcggtgtcgctgagtatcgggataagagaagagtcgagactgcaggacgggatcggccgaggtctcccagccggggacggtgttggagggagagaaggcagcctgctcggtctcagcgaagtagttctggacgttcttgttaagagtgagcttaccgaatcgtctgagagggaactggtcgtgaggccagaccttggtgaggtcaaagacggaccacttgagcttctcagcctgctcgggggtgcagacctggacgtaacaagtccaagaggggaaagagccactcttgatggagttgaagaggtcttcctgggcgtggtcggggttggttccggagagagcgacagcctcgtcattggtgaggttcttgatgccctggtcggtcttcatgtggatctggacgtagttgaaagagccatccttcttgatccacttgtaggtgtggccggagtaaccgttcatctgtcggtagttagcgggagtacctcggtcggagaagaggaccatgatctggtggcaacactcctggttgttggcaatgtagtcccacatcatagtggcgtccttgaggttggtctcggggtttcgcttctgagtgtggatgaaaacggggaacttggaggggtctctgatgaaaaagacgggggtgttgttgtagacccagtcaatgtttccctcgtcggtgtagaacttggtggcgaaacctcgggggtctcgagcagcatcggcggatcccttctctcctccaacggtggagaatcgagtgaaggtcttggtcttcttaccgatcttggacaagaaatcggcgcagttgaggtcggtgatatcgtcagtgacctcgaactctccgtaagcaccggatcccttagcgtggacaactcgctcggggattcgctctcggtcgaagtgggcgagcaggtcgatcagggcaaagtcctggagcaggagaggtccgtgcttgccgattcgctgggaggcgagggggtccttgacggggttaccgttagtggtggtgtaagtggggactcgttttccagacactgagttagtatgctattggtgttgttgttgttggctttaggcgagttgtctatcaccactgtcgtattatgttgcggtgttcggacttgagcgtcttcccctcattgatggggcaatatctatagcccgtgaaaccaccagatcatccgaatcaacccgctgcgtccatggggctgctttcccggtatcgaattgcccgtccaaacagtcctcctgggtactcacttttcaataaggccttagtttcgtcttgactcggcgtttcgctacccccacctatatatatataatcacacgcacatggtttgtgggagcttaaaggggcgtgtgaaagtcgcaaacaaagagaattaccgaagccaccgcataatatagagttatcgtggggaaatgtgtggactagatttgggttaagggcgagatggcggtgtggagttgagaaatggttatggctgttttggggctctaacgagctcaaaactagctggatttttcgatcgagcacttttccccattcaattctttgatttccacgtagctactctctcggactcgccactcggtgcttctttcggcacctaccatgccctcttcattatcaccttaactaagttcttgttgggaggggaaaacccggggtcacagccaatagccttgcagcgtttgtcatgatcgactatatctacagcctgagacagacagaactacccacgacaacctgttacagctgcaaataagataatccagcggtggagaaagggtccgcgaactcactcgtgtcttgttgaagctggtttccccccaatcgttacttcctacagattctttgtgccgaatgcatgagacagcaagcatgtcaatgtagactaagaaaaaagcgtttcaacgtgttagagcgaggacggacgtcccttttctcgtctttgagccgcggtccaaacgtcaaaagcccagaaaacagaaaacagcctgaaccttccccacgcgcaataaagtacaagtagggtgagagaaggaaagggtagaaataggttttcttctgtttccagagcctgtagaaggtctgctgtttgtgccattccaacgctgtgttttacacgctttgtttcagtgaacttctccgcggccttgtcttatctgtctgccagtcgttgagggccatatcggacatttccaaccgccaaaacacacgcatattgccactactggaagccccagccgtgttcttgtgcttgaactctattacgttccacactcatttgagatttgtcatggaccgttggtctagacttggccatgcagagtttgatcacgggattttcacggaggtggatttttggtaaacagagcgaattaccggggtgtctacacagtcacgtgatatttcactcaaaggctacggcgagtatgtggtcgccttttggggccttggcttggtttgggaatccgacgatccctatagatctcagtcgaccgtccttccttggtattacagcaggtatacatgtatatacatgattactgagctgcctaagtgcaccagccttgaagacatgcatacaggccacatgactagacacatggaaaatacctttgggatgtgttttactgccctcaaattcgcctaaccccaaaacagttcgtttgttttatcgcgctcatgatgcgtaaaaaaggtgtcttggggccatcccccaacaaaatctagaagtctggctgtcctcaaattggaagcatattgagtgcagtatcagcaagtagacttcggagtgtaagtaccggtacgcgtacagtagaaacggttgtgggggtaacgaacagtattggttattcgtgtcgtatataccgaagactcttatcccccaacatacatatataatcgcatcaactctctctgcttgttatggtagtacttgcacaaaggtcggaccctgcattacagttcacacaatggccatgatacacattgagccctcgtatatgacccccacatgcctacagtctgtaaactcttcttcagaggtgattgaggtgtatattagctatggctcgggctcatcatcattctctgtcattatacccctcgactctggctataaaatcgcctttcgctcttctctcctggtgctagaacgaggaaaagtgttggccataataacgacattagtaacaggaaaacagtcatgtcatggcatatctcatgagccgaacaggtgaagacaatgtggttaaaagacgaagtatataggtgtctagcgtatataatggctgcaaatactgtagtagatgcaaactgcgtccttactgctgcagtagctattggaaatctctcatcgacccctgatgtcaccccattgtgtgcataagcggatgcaaggtggggagaccatattttataggtgcaagagcgatgtctgaatcgttgttgagtcaattggtgttttttggatatgctattcttgtcaaatagacacatactacaatttcaaatgcgtacaaggctttcaagactcctaaaattctcgttttactatcagatcagccacaatattcatcagcctctaatttcccccagaggataagctctcagcgtcttgaatgtcttaactcggatatgtctgtattcaacggtttaacaactgcatatggtgggatcacacgtccatccagtggccggtatttgagtgagtatatgtgacagggaacgggttacgttataagctcctttatcgagttccagcagtactcgttagacacatgttgtgtataagtcagcatggctctctctgatctgatcctgaataaactgatcaccgcacaatacaaaccacacccatacaaggtagtctctcattacaaaacattgggccctcgtgcctctcactactgtagctaccagtgaacaaactctctgggttcccacagtcccacgccctacgtgtatatgtaaacattcatattgtcgttaactacacagtctagtaaggacctgaaatgacttatgacacgccgcgcgttcgcatttgatagtcgtccttttacaatacctcctccttaataacaccagtgagccagtccagaccctcactaagaccctctcccttcagagcactgcagggcatgatgctccagcttcgatccttgagcgaaacgagatcgagagcagtggatacctccgccgcggtcatggctccctcctgatcctgcttgttggcgaaaacgagcagcactgcgttttgtaactcgtcctcctccagcatggaatgcagctcctccttgcacatgtcgattcgctgcttgtcggtggaatcgaccacaaaaatgatagcagctgtgttggcgtagtagcatcgccagtatggtcggatactggtctgtcctccgagatcccacacgttgagtttgaggtttttgtaagtcagggtttccacgttgaaaccaatggtggggactgtgtccacaacttcaccaagctgtagccggtacagaatggtggtcttgccggcaccgtccaatccaataatcaggattcgaatctccttgttgcctccccacacacggctgaacatgcttcctagaacgtttcctgggttagtagagggtcagatggtcgtgtcagtcctgtttcgtcccagctgtcattgttcacgaggcttggcttcatagaagtcgccagcagtaactccatccccaccccttctcactcttactcacccatcctgtatgctgtgtcttgttctttgcgccgaggaaggttagtgtcattgtgatgatgtagcacttactatatcacatcacgtggcaactttatgttctttgcaactagacacactacggcagggatacgaatcgtctacaacggttgatggtgaaccgggccgttcggatgactcgtatgtttccttcaatacagaatcagccttctttttccccacttttgacctgtataatcacctcagaacagtaaatcgctgcttaactttcgtgagagatccaacaaagggattgtatagcgtcttggctaatattgtatataggagtgttcgatctataaattgggtcaaattcgtgtccagatacacgtagctatgctgcaacaatacttgtagtttggtgtttttctacccatcgtaccctacacagatactataatacgcaagcgcgtccatagccatgacctctctccagcagtagctactcgaactattttggataaccacttttttcccattcgtctcatgaagatgcaaataaatattacgtaaaaatacaaatagactgagccaattcacccctcagtctcctccccagtagcctttcgaattcgctcccgaaccagcacatcaatagcttgatcagtctctctgtcaagctgatccagatcctcctggaggtctcgcttcagatcccagttggctcgtttcggctgcaactttagatagtccactgcagattggttcttctccatcagctcctggatcgtccttgcctcttcctcagctcctagcagctcaacagtctcctgtccttctgtcgggttggcatcgtatcccagtttggtcgactccgtctccagatcgaagtttcgttccttgaatctatgttagcgaatgctcgatgttgttctctttcttcatccaagaccattccccgtgtcacctcaagtcgtatcgcatctccccatccccatactcacgttggcttttcctcccgtgtagcaacctcggcctccacgggatcgaccttcttgccctcccggagagcccgcatacgcgcgagcttctcttttcggctttccgcttgtgcgctgagagacatgtcgttgaaggtgatatcgattcggtctcagtatcaatggttcacacactgaaactttatgcaaacttctgcgggctgactaatcttactacttcacgaactgtatgatatattcggcatgcatgaaactaacttgacccaaaaaaaagacctgacactctgacaaacaccactaataactatgtcgctacctggcctcaacttctcaacaactgagacaaacactacagaatccactcataccatcgacctcaaaccagagacggaatggagatacgaagtggccatcgggggaaccttacatgtcacgctgaaatctggaaccgctgaaatcttcggtacagagctgccacctaacaaggagctcagtatccaaggaaaaggaagcatttacacatggcagggctgccagttcgtatacacggcaattgcaggacccaagggattgatgtctgattacacaaccgaagacactccccacatgaccatggctatcaacctgcactttgctctggagaagatgcggaatgaggctgaacagaagcccaaggacgttgctggacctagagttctcattgctggaccccccaactcgggcaaaacctccctggctaagattttgttagcctatgctacaaaatgtgatcgaaagcccatatatatttctttggatcctacttcggtgaacctgggacctcctggaggagtgcatgctgtccaaattacagatctgctagatgtggaaacatatggaggattcggatcatcggaaatttcaggccctcagaaactacagcctcttattttgctctccaagtactttggacttgagaagactacggataacttcaagctcttcaagcggtctgtggctcagctagcagttcccgtcctgtccaaacttgcacacgacgttgaggcgcaaaagtctggtctcatcatcgacactcctcgagtacccggcaaccaaaacaaaacaatcgaagttaacctgctaacggacgtggtgagcgactttggagtcaacgtcattgtcgttattggcaacgatcgactttatgcagacctcatgaagaaatacccagtgggagcctccggtcccacagtagttaaggtaccagcatttgcttgcatggatgacgatgagagctacaaccgagatgcccagcaacaggaaattcagcagtatttttatggagatgctaaagatatgaaacttggtccacgaatcgtcactgtcgatttctctactctccacgtttacaagatcaagccttccacacagtttgacgatgacaaggcggatatgctggagagggtcgcagaggccaacattctaccaaacacagtactgacggtcatgcacgctgttcctggctcgtccgaaaaagagattctcgactcagaggtccaaggttaccttcacgtgacggaggtggacgaggagaagaacaaggtgaagattctgactcctgttcctggacgactaccctcccaggtcatgcttcttggtgatacacgataccatgagtaatacgatagatatataatgtagataatgtatttgtatatatgggcccatcggtgctgtagatatagactcttttgtgttaactgtagaatgatctcactcattcaacacattactcgtacagtataggcaaaaagaggctacttgtagtgtcacagtgggcttctgtaatgtaaaggcattctcctactgtcacgacacgtaaaatcattaaataatcattaatagtacatatatagctaatatacatctccttacaatgccctttacttgagagactggatgaagttgtccaggttgtactcctcggtgtactctccttcgtcccacaactcgccgagatcggccaaagcagggttcttcttgccaagcgatccagtggcatccaaaccggcgtcctcggcgtttgcatccgccgctgcggttccgttaccagccgctgccacgtcgtcgacattaaagagatcaagcagttgatcagtgtccatggaagagagaccggagttctgctggttgatgaccgtggacgcaatgttgagcttgaacttttgcagacccataatcttctcctcaagagtgtttcgggtgatgagtcggtagacgttgaccaccttcttctggccgattcgatgggctcggtccatggcctgcagatcgttcattgggttccagtcgtgttccacaaagatgacggtatcagcaccagtcaggttgaggcccaagccacccacatgggtggtaagaagcaaaacatcgatggaaggatcagcgttgaacttctggacaatatcgtgtcgatgtcgagcttcagtagatccgtccagtcgcataaacgtaactgtaggcatatacttcttaaagagctcgttctcaacaatgtccagcatgtccttgagctgacagaaaatgagagctcggtgctgagaaataacagggacatcgccttcagaatgttgcttcttgctggtgccattcttagcctcagctcccttggtctctccgataccacaatccaacaaaagtcgctgaagagcctgcagcttgggagcattgttgatggatttgacacctgtagctcctccaaactgcttcatgatcttgctaaactttggatgccgctcattaagaaccagagcagggtggttgcacagctttcgcatgtactgtagagcctggaacacgtgctgcttggactcgaccgtctctgtggtgatttcgttttcgaccacagacttttgcttcttggcgaagtcgccgtacagctctcgctgtagctcggatagttcgcagtagtagtcctggatgatcttagggggcagatcagacagcacgtcctccttgagacgtcgcagcaggaagggcaaaacctgcttatgcagagcctccaaagccagagctcccgcttcctgctccttggaagaagacttggagtttctagaagaagcaataggcttggcaaaccgctcattgaaaaccttctcggtacccaggaaaccgggcatgaggaagtcgaacaacgaccacaactcaagaacattgttctggatgggagtacctgacagaatcagacggtggttggcgtggatctttttaacgctctgggtgagtctggactgggggttcttgatgatatggccctcgtcaagaacacagtagttgtattgctgtttggtgaagacagcattgtcgtttcgacagatatcgtaggaagtgaccacaatatcgtacttgtgcagagagtcggcatgcaggtatcgctgagagggatgtccagcgtacatgagaacagacaggaagggggcataggtgttgagctcgtgtttccaatgtccaatgagggtggggggacagacaatgagcgaagggagagctctgacttgcgccatttcgctcttgaggccgtccagagaggcagcgtccgtgtttccggcgctctccagctccttgtacttgccctccagctccttgtacttttcagcacgcagataatgatcagacgacacaatacaaatggtctgcagagtctttccgagacccatatcgtcacacagaataccgtgaagttgatacttgttgaggaaggccagccagttgactccgtcttgctgatactttcgcagcgttgccttaatgctgacaggcagagggaagggtttgatcttggacacgtccagcatctgctgcaggaactctcgctccttgtctcgaccctcaagcagttccttggacatgccttcggggtccgggataccactttcgagaggaaccagcttgacgatctgggcaaaagtggtggtggcaatcagacgcacgtcctgatcggcatctgacatacgacccagaataggaacaatcaaaaacacaacgtagggaagaacatcgttgcccatgatggcagcgaggtggtagatgcactcgacagctccctggcgtctgtggagagacagagggtcgttgagcataggcaggacgattcgaaccagctccggaatggcctgaagaggaagagtggcacaaatggtggcaaaacacttcgcagcagcgtatcgcaccacggcaaacttgcttcccaggtgggtgaagacgctgggcagaatctccataatcttcgaatgcaagttagtagacagacagggcaccagagctcggataatactcagagagtcaaccacagactggccagaggtgtcttctggagcatagacactgtccgagttgagctccaccttgagagggtcgaacatgatggactcaagctttttgcacttttcaaacacatggtctccaaactcgaccaacatgccctgaagagctgtctgggcaccccctcgcttgattcttgctgccttgacttctcgctggtgagcaatgacgtcagcagggtcggtcttggcttcctcctttcgcagggacagaatgttagactccaccttttcgttgaagtgaaattcaggtgtctcggaggtgtcgacacacaggaaggcacacaggttcttgatgatcttgtcggtggctccggtcttgccagcagctccaaacaaatcaaccagatgcacaatcgttgcagcagctcgatcctgcaagatgacatgctcctcacccttgatggagtccattagagctctgatgactccgttgagcttgggaggaaggccgccaatatgaataacggcagatgccaacgtgctctggatagacacatctctctgggtcttcgcctcgtgcgcttcctccatggcctgagaaagagccaggagcgagtcctccatgagctggccggaagaaagtcgagcggtagtggaaatagtctttctgagcttcggcacgtccacgtcaatcagcttctgagcctgctccaaagaaaaggcctcgggtccagcgtcagcttctccctgtaccagaataggcagctgaggaagcttggcagcagtgctggctcctccagcgtcagcgaagactcgcagagcagaaagagcctgcgttcgaacagccttgaggaaaggtgtaatgtcggcgtacatggcagcaggaggaggagcaacaaggagctcagaaacagagggaagaaacagcttggcagaaggcccacattcgtcaaagataagagcagcaactaatcgctgggtggagtacttagatcgagcatacttgtccagacgaggttggagaccttgcagaagagactcgtctccaagtcgaagtagctgggcaaatgcaccggcagacgtaactctgattcgcaggaaaacatcgtaaggaacaatactgatatctccaagcaaaatggggttatcaatgttgaccaccagttgctgactgccccaatcggtctccttgtcagttgtcgtctttcgcttggtgttcttatcgacagagtaaatacctccactgggcttgacaaacagagaggtttccatcttgtgagaatgacgagccacaccaatgggagtcataagtagagataaatagcccacaaatgggaatttggtgagttcttcgctgggagcagcagccagcagggccgtccaaagctcgtgtgccagagctgtcaccgaagggttctgctcaaccaaaagaacctgaaacacgagtctcaacaggtgagtggtcacccagggagtcttcccatcgcccttaccaacacctaaaagagtcaacatggtcgtcaagacgctctttcgcacattagtgatgctgtgtcggaagaaaggatacagtctggggaccaggtttctgaagtcttgactagggtccatttcggcattgatctggagaacatccaaaacccgaggaatggcgcacaacttgccgaggagatccatcacgttaccgatagatgcactcagatcgtctctgagatcggttaaacactcccaaagcacgctcatgagctcattgatacgatcaggtcttagagtgatgtactctgagatgacggggattagtgtggcggccgaaactgcctgcacgtcatcatcagactctctgaggccactcagaacggcttcatagagatcgtcgagataggccttgtctttgaacagcaggtcagttcgcacagacaccagatatctcagtccaagcattcctccgtgtcgagcttcccatactgtcatggaaccaggtttgttatacttttgtagcaccagtccatgcaaaacagtgaaggtaggtctgatcgtcttctcgtccatatgcaacagaagagcaccaagggtctggccagaggactctcgaacaggagcaacgacctggtcacccacgtaatcgccaaatctgtccagagcaaagatacagcacagtctacatgccaaatcttcgatccactgccggtttcgagcgtcattctcctccacggaggaaccccgtacccgtccagcgccctttccgtgcaccttaaccacttctctcagtcccagtgcggctccatgtcgagtctcccagttatcgtcgaacaggtcgaccattagaagttcacaaagaccctcaaagggccaaactttgcctgctccgagctgaacaatgggggaaatgccttcaaccagtaatttgccatcgttttcagaggtgtgaatgcctccaggggtgtcatctttgataacagtctttcctccatcctccttcttgccactgacgtccacaatccgcactttgttcgcattgttgcccttttgtaacttggctcgtctcttcgccatggctctcagacgagctgaagagtgtccgtctgccggaggagtgggggtggtttctgtcttgacctcggtcttgatttctggagtctccactttgaccttctccaccacattggcttccaccttgacatccgactcgtccagaagaccgtcctccatgtactgacctgccaagccaagccggctatttaacgtcttcttttgcttctgaagacgctcaatgggatccaggttggcgtacatgtcctcatactcttttcctccgcttcccagcagtttgcctccaaactggatgaccttctccagatcaaatgtctcgaaattgagcatgccatctgatagcagagaaatgtcgaggttggctgaagccgattcagcaccatcctcggttttgacctcactcttgacagccaagttatcagccaaagcagcatcggaagcctcctccgcattggggtcccattgaggacagttggctacaatgcctccaatggcacgagccgccgcaattcgtgtgtcccattttttcgactttagaaacgggaaaactcgcccgagtagattgaatagttcttcgggatggctcttttgaacatctgccagctggtcagccgcagtattacgcacaaatgcagatgagcctgtgtctagtagcaatacaagacgatctaatcgagacatctgggttagtaagcacaatacatgagacatgtgatgtgtctgcagggaccaattgagacagacatgcggcaaaaaaagacgactcaattctgcctgtcaatctctcctatcgctcatcttcttttgttcgtcatcttggtcgataggtctaccctctgatagactcaaaattaaggctccattgacaccaaccaacgtgccttgagcagaacactccacttgtctcccacacacttcttccgagaactcacctataatcacaatctctgttgttgcgtcctaaatcacactgaatcgtcgttgcacgctggtatcgtttcgtctggtcgaaatattcttggttctcgcgttagtactcaagtcatttagagttcccacccacgatacgcgtagtaatcgtgggacaggtgtatccagccaatttctctcggttttccgttgctgatgggctgtatgcctctttaaaccgccttagaatcttccccgccgcatttttcgccaatactcacaccttgaccgacagttttgccgaaatccaatttttgcaaactggcggcccccatcgttaagtacactacttttatatgcgtaacgacggcgccaatagagttctagggaaaagtttgatatattttctgggccgggtaaccccatcaagattgcgcttacgtaacccaatggctgttttttagaaccgtactaaaacgaaagcagttggagcaacaccctgtccaatcatacggcgagcatttgttcatggtttcctgtcggaagtgcgcaacaatgattttttgtcgacgccacaggatttcttgctcgagactccgaatacacatacattggtcgatttgagagtgcatgtgtgctgcgggccctccattgaaggtgttacccggcagataatcccgtctgagccgacccagcccactaatttgctttactaaggagctttacgcgggaccttgagctgcgacatgatgatgctacaacggctggcagaaaaaaagagccgcctttagggttccaattgagctgaacaatcagaaacatgatagccggaaattacaagtacaagtatgagtcttacaaagaagggagttatttggtgtggaaattttttttgtgccaagtcgcctaataccatttacagctaccatagctataaccagtttttgttccttgctctagagagaacgtctgcgtagcgtacttacttggtcgtacgcagctcactccgtttattactccaccaagtcccaagcgctccgcccgcgattatgcaaaattaaagtgctgcgtgagcgagatggaaaccatggaacaacgtgatgcgcggtgggtgaggggtgaggaattcggaaaatgtggtcatctagagtatacttgatagtcggattgggtaagtcatggcttacaggtggtcgacgagtgttcagtcacctcttgttttctccctgtctctatgctatggctcacgtttggcacgttcacgttatcgactagattagctatactgtatactgctgtgacatggtgtgcactggtggtgcacagggaaccagacaatgagtcgacctccaggagtttattcacaagcgtataagagtgttgtcggattgtcttgatggccagaatctattccggcatgcctggtccagattgcacttttctgcggtgatatacacctatcagttctagaccctgtccatcaaacctgtgagcaataaacgctcgaataaagcacatcgctttttacaagtggtgaaaaatttcaagtgtgagcttatttggcagggtcaggaaaaaaagcctaaaatgtgtcattgggagcagtagcaattagtcatagtaagagagcatcgagcatataaaagactttggggtcccccagtttagtctctctttttttctttcttcttctgacagatagattctcatccacctctcctctaacacaaccaagaatcgctaaaaaaatgtgcgcaacagataacgcccccgccgctaacgctgctcctgagaagccctccaacgttggagtcgaggtcggtcacaccggcgagcagactaatccttacggagccaaccccgccgatttcctttctaacgtgtccaagttccagctcatcgagtccactctgcgagagggagagcagtttgcctctgccttctttgacaccgagaccaagatcgagattgccaaggctctggacgactttggtgtcgactacatcgagctgacctcccccgcagcatcggagcagtcgcggtccgattgcgaggccatctgcaagctcggtcttaaggccaagattctcactcacatccgatgccacatggacgacgcaagactcgctgtctccaccggtgtcgatggtgtcgatgtcgtcattggtacctcccagttcctgcgacagtactcccacggcaaggacatgaactacattgcacagtccgctgtcgaggtcattgagtttgtcaagagccacggcattgagatccgattctcctccgaggattctttccgatccgacctggtcgatctcctcaacatctaccgaactgtcgacaagattggtgtcaaccgagtcggtattgctgacactgttggatgcgccaacccccgacaggtctacgagcttgtccgaaccctcaagtccgttgtctcgtgcgacattgagtgccatttccacaacgacaccggctgtgccattgccaacgcctacaccgccctcgaggctggtgccaacctcatcgatgtctccgttctcggtatcggtgagcgaaacggtatcacctctctcggtggtctgatggctcgaatgattgctgctgaccgagactacgttctctccaagtacaagctgcacaagctgcgagacctcgagaacctcgtcgccgacgccgtccaggtcaacatccccttcaacaaccccatcaccggtttctgcgccttcacccacaaggccggtatccacgccaaggccattctcgccaacccctccacttacgagattctcaaccccgccgatttcggtctgacccgatacatccactttgccaaccgtcttaccggctggaacgccatcaagtcgcgagttgaccagctcaacctgcacctgaccgacgcccagtgcaaggatgtcactgccaagatcaagaagcttggtgacgttcgatctctcaacattgacgatgttgactccatcatccgagagttccacgccgatgtcaccagcactcccaccgttgctgccaccgagggacctgccgttgaggacgagcccgccgccaagaaggccaagactgaagagtaaggtgttcttattttcagtgtaaattatagcatgtaaaataacacacgcaaactggaggacacagtccgagggtttgtatatatcgattatacggagacatattcgagggtgaatcgtgcatattgtagaaggacagtaagagccatagatatagcttacattgtgtgttatccgaatacgagtacatactgtacttgcacttcggagatagaaattgtgattagctcggatgcaattttttcaacctgagtgtatgtcaaattaggtcccgattgtcgctccgacggtagatatgttatgtggagattgcttcggagataataacaaaaatacaagcctcagatgttcaaacatgtatagtcatataatgttaacttgagggtgcatctaacaggcgtctccggtgagtcatttcattctcgacgtttttattgcttcttgctgtgtctgatggtgggttgtgcagcctaggagcacatcgtacacacacatacaatcatggcgttgtgtggaagtgagacatgctatttgtggtgtttttttagagcaagtgcttgtagaggtatagaggctaccaatcaattcaattttcacttattgtcttcttattgtatagtacagtacatacttgtgaaataagtacctggtacaacatacttgtacatactgtagtctatgtggtgacatgtgaagtacaaatatacaaatacgtatatactgtaccggcacatttacagtagcagcctgacatctcttcagagtggcaagtcagacactcgtaataagtatacagatgctgcttggaccactcgctgtgccatccctcgcgtccactcctatcggcaggatctgatgcaagataatcaaggtggtacttgtccggtacactgtatgtacttgtactcgtacttgcgtggtctagattaatatgataaatgtgtccgagacatagagatgtgtcctgttgtcggcaattcaggttagcgtgtgattgtagttgaggcaattagtccctcttcgaggtgtatcgcactacctgctccaactaatatgactctgatggatcttgcaatgatccagagctcgtttccacgtgaccttcttatcgagctctgacccgaaattgtgcgccaccatagcttccaaaatgcactgggctgatcctccaggcacgacctggcaggcactgagatgtttggcgttgcagctccagctgtagtcttcgttggtgtagagagacaaggtctgacgagtcagctgatgcagcgggttcttcctgtgccttttgccgaacggaagaggatggctgttggataaaatgagacacagcattctttctcctcgtgaacacgaacccatggcaaaatcaaaggtcggaatgttcgagtgaggtaaatgtttcacttcccagccctggggggcttgacagtcaggtctagacgtgacgagagtgccctctgggatccattcaggcacctcacatgatctatcatcgtccatggcgtacgcgtgaagtcgctgtagaaacacaatgtcggagctcacgtctccaatgaggagatcctcgaagttccacaccacgaaattggtgacggtgggtgaaaacaggtaccatatagatagcagcgagagggctccaagcgcatatttcaacctgccagaacgcattgcttccgtgtctgtttcagagcctatcggtggttatcggaggacctgatggatccaaaagtggtggatacgggtcagaaggaacactcccgactctgttgctactagactggaacaatttattatacctttttttttttctgcatatacattcatttaattataactttgctgtgaaagaataacctttgaaatgaatgtacgcttgcacgaatattactaattaaacacgtttagtgtcatggtccaacttggcacgtacctatttccagtaaaaaaatcataaaaaaacctggttcagtccgtgttgtatgttggtccacatagcttcgcgtgtttgttcgttcatcgggaaaacgccactccagtctccagttctctaatctcaatccttccattgccctcttcgtttgcattgcctttgaaaacgtctccttgtggttcttcttcgtcattggtttggttctgcgtcccctgtggtgactacgcgccctgcaacgctgttctctcggtggcctcggccgccttttgcgcttgctactgtctccttcagggcccgttttagatcaacctcctctgttagttacaccttaacatgcccttggttcagttgtctcaggataatacgtaataggcgatacaacggctactggttttagacctatgtaacattgatgaacaaatactcgtatcaagtgattgtcgatccaagaaaaaaagctattcccttggcagtgcttcgttgttcatgtcgcagtaattctattattgatcacgtatgtatattgtctgcatttactcctcacgtacccattcgtagcgatacgtcgttaagccaaagctgcttcgaagatcttttagtcagtataataacacattctcagtttcttaaaccgtaagatatcttcaaatcactgattatgtcttcacacgagggcttcggaactacagttcttgttcctcttttatatacccacactaactatagatcatgagagagatggatgccccgcctccacctcatcccttagttaagcttctacttagctcatagactaaggcgctacgtactgtaagtttccaggtctccgagggccgcacaactacaaatacagccaagctagaaaataaaggaagacctggaaacaattgacgagaaacaattcgtcaattgtttcagtctcattagcacttaccactacttgtatgtattcttgcacccttccattaccacctcacatgctacctacttccgggtaactacctgtagaacctaactttctcctgatgcacactatggtcaacacacagcaaagttcagcaagacgtcgtcgacgacagtcactatcacacagcacaagatgcccgaatccaaccagtctggcgaggccattttccgtgagtactatgcgaacatgtggctcgagtgaaacatacgtgacccgtccattgccacaacaactcgtctcatactaacccaggctctgcggagatgtcgctggttcagctgtacattgccagtgaaattggacgagaaacggttatgtctctgggcgagcttggactcgtgcaattccgagacctcaacaagaaggtcaatgtctttcagcgaaacttcatccaggaggtccgacgactcgacaatgtcgaccgacagctgcgtctgtttgagcgagaatgtgaaaaggagggactaaccctcgaggacggcgatccccacagtgctgcttctgcctccgacattgatgccctggtggctctgggcgatactctcgagaaacgaatcaccgaacttcgagacgccgaggagcgagtcactgaatctcagaccgagtcgcaggaactgcgagctgtgctcaccgaaaccgccaagtttttcgaccagcgagccggaggcggcagccgggacattgagtcgcaatctctgcgaaacgtccagtttgttgctggagttattccccgagaccgagtcgaggtgctggagcgaattctgtggcgagtgctgcgaggaaacctgttcctcgagaccgctgagtttggaggagacgacggagacaagtccgtgttcattgtgttctcccacggagcggaaatcatctccaaggtggagcgaatcgccaaaactctggacgcccacctgtactggattgccgatgatgttcgagaacgagagaaccagctccaggaggtcaaccagaagctgtccgacatcgatattgtgtcgcagcgaacccgacacacccttaacaccgagcttcgtctgattgcccagaagctgcccaactggcgagtcattgtcatcaaggaaaagagcgtatactctactctcaacctgttccagtacgacaccaaccgaaaagtgctcatcggcgaaggctgggtgcccaaggacgacatttccaaggtcaagaccaccctcaagtccatcaccgacgaggctgacgtcgagatcccctctgttcttaacgtcctcgaaacctctcgaacccctcccacttaccatcgaaccaacaagttcacttcggcctttcagctcattgtcgacgcttacggtatctcttcttaccgagaagtcaaccccggtctgcctaccatcgtcaccttcccctttatgttcgctatcatgtttggtgacattggccacgggttcattctcttcctggccgcctttgccctggtctactatgaagccaagattggcaagatgaagcgagacgaaatcttcgacatggcctaccagggacgatacattctgctgctcatgggagccttctccatgtacaccggattcatgtataacgatatcttctccaaatccatgaccctgttcaagcccggatgggcctggcccgagtcgtggaaggagggacagaccatccaggctcaccagaccggcgtctacgcctttggtctggaccccacctggcacggaaccgacaacaacctgttgttcaccaactcttacaagatgaagctgtccgtcctcatgggccacgtgcatatgacctattccttcttcctgtctcttgtcaactacatcttcttcggctctgttgtcgacttctggggtaactttgtgccaggtctgctcttcatgcagggtatctttggttaccttgcccttactattgtgtacaagtggactgtggactgggtcgccattggccagcagcccccctctctgcttgataccctcattaacatgttcctagctcccggtaaggtccctgtgcctctgtaccccggccaggcatatgttcaggtcattctcgttgtcatcgctctcatctgtgtgccctggctgctgcttgtcaagcctctgtggctacgacgagacatgcagaagcatgagtacgagcgggtatctggcaacggcggtcctctagacctgcttgatgcccccgatcagctcgaagagactgtcggagacactcctggagacgccaccggaggagacgactttgatgatgaggaggaggaggaacatggatttggtgacattgtcattcatcaggtcatccacaccattgagttctgcctcaactgtgtgtcccatacagcctcatacctgcgactgtgggctctgtctcttgcccatgcccagctgtctactgttctgtgggacatgaccctgcaggccgcctttggcttctccggagtcgtgggtgtcataatgaccgttattctctttggaatgtggtttgtgctcaccgtggttattctggtctgtatggagggtacttcggccatgctgcattctcttcgtctgcattgggttgagtccatgtccaagttcttcgagggtgagggcactccctacgagcccttctccttcaaggacgaattggctactaactgatagcctagcattctaacataatacattttaaacatttagccgatgagtctacctatagatatataatcacagtaagcctaagcctctgtgtgtgctttgatggcagtccagagcttatggttctcaccaagagcgtaagtgagagtcttctgactgtatcccttttctccaaggaaaccaagatcatcaataacgtcgtttaacaagatggccttgccaaccagctgactgcttccaagaccctcgttgttgatatggactacatggacgtggagatggtagtaagagggctggtagtgcacaaagacccgcagaaaggacctgtcgacattatacttgtctttgaccaccttgtatatgtcttctctgagctccttgagccactgtatgtgagagtggttgagatctctgatagaagtaatgggctttccactctctccctggccctcgaggtttctcaaagagatagctaccaaatacaaggagttgacattctttctgtcccatttcatgtcaggtagaagaacaaacgaatcctcctttcgatacaccacatcttccgcctccttgccatggtacagaatgttatgtacccactggattcggcttccgagctgagtctcaatgtatggccaagtaacctgctgatacagctcaggggtctcgaccaccattcgagtttgctgctgcgaatacttttgaacatgtgtttcggatgctgggtaaatgaggttgatcttgactccgggccgcttattcacgtcctgcgcgagagtggcgaggttccagtggtacacgtcgttattttcgagctgcttgacctctggaaagatgtctggcgaggcaaactgttttaagtacgcttcatcggtaacttcaaatggcagtttctcaaccgtcaagatcgcattgtcgtcgccaatcgtacccaacagcgtcacggtctttgactggctgttgaagttgagcaattgcgtgaattgaaagtctcggactctgttcattgtcgttgtagtggagtggagggggcgacacaagtacaagtatagtatgtactgtatgtactgtacacgaagaatgttgcacaggatcgaaattactgacaggcttgacataagaacattataatcatcgtgttaaaaaggagcgggaaaagaggtggtaatcacgcggtaagtacaaaattatgatgaatatatttggcacatctgaaaaaaaaaattggtgcaaaaacattccaaaccctctgttccctacagattactcctatcgtgctgtttcaacagaggccgttcaaaatcactgataaagttctgagcattccaatacagacataagcgaacgattcttttcactatcaactaacgacatgtcgacgccagctacaggtctgtctacaggcgacactacgcacacagcaacggccagcgccacgtcacagacgcctctggaggtgttgcaacaaatcgacttcatgcctcacgtccaggcgctggtctccaagattgtgaacggccagatctccgtcaaggacgccgacaacgagagtggagccgtcaaggtgcgtattgccaaggccaaggctgctctggccgagatggacgggctggacgaaaccatccattcgcgccaggccaaaatcgtgtctctggaccagcagattcagaagaagctggagctgcttaagtcgttcaagcagatggctgaggcagagggctttgatttgtctgaacaagagcctaccgaggccaagaaggaggattcagcgactacgacagctacaaccactgctgaggctcctctagcaagctccaagaccgaggtacccgaaaacgccattgaagaggatgttgaaatgagctgaatggcgatgacattgggcgctgagtgcacagttcccaaagttatgctattacggtctcatagcttggttgcatgtcgaagtcgtgcttgccttacccagtttgactatactttccccacacttgagcgtggaacctcttacaggagtccacggttgagaggggtggcgttcggtggggggtggtaggggtggtggtagtggtagtggttttgagagcaacgtctagagttggccttgtcgtgcaccttccaatatctgacacctccagcttcgtccatcacgtcattacctaagtatgttcgtgtttcaggtggctgtcactatggaattctggcgtaccgctttagtgcatcagccgccgaactcgtgacctgtcttacaagttacaaccctcaaccggccacagtgctgcagctattcactcgcttgtttcttgttttttgtttcttgttctgtcccacctgaagctttcacttttgtttagagtccatatagctaaattgctccgtcacttgtctaatacaaccacccaccaacctacagtcaacagtacatcgtacactcaaccccagtaatcccaccaatgctccctaccaccctttccaacccctcgtcgacgtgcgtgtccgtgggatccgacacagagtaccagcgctatctgtcgggtacgccgtcagaggtcacatcggtgccttcacgacccctgtctcgaagctccacgttatcgggcatctccacgaccgccactctggacggtgtggagggcaagagaacacgtggccggctccacgacctgattcccacgtcggacgccaccctggacattggccacagtgagccccacgcacagccagacgacgaggtgcgccagactgggccccccaacagcgctcaagccgctcgacaacaatctacgactactaacaacaataacaacaacgacattaacgcaacgacaccgacgctgtcggcatcaccggacgagcacacgcaactcgacaagggcaccacccgtcccgtcaccatcgaggagaagattgagctcatggaaggaggtccccagagcgatctgcctaacgagagcgattttgcataaagcccgcttgtgttccctatcttctattattattctctacaagtactggggtttttttctctactagcatctaacggaaaaatggcacgaacagcaaaatactcaatgtatattattctagaaaggtccttctgtaggaccctggcgtgtcgaccaactgtcacttttaacaccttctctaacgtctcatcgtacatcgcagatagttacatgcaataaggttacaagcggggatggaagtgaccacccactcagagcgggtgtgcttgggcgctgtaccgtgaaatatgtggcgagtggacacaacaccaatgttgcagtctttggcatcacaccttggcatacaactaagctccacggaaagcggctttatatatagcgttttggatcaaaagggaacagtttcgaaccagctcatggctacacaccgtcgagtgtgcatgaaccaatcagagacgctaaatctattgatgtggaacaagtcatatgagaatacacaaaaataccatggcaattgtcttttcccgtacaaaaatttagtccttcgaattcaagcacacacaattgctggtgttttcccaacaaattctcgcagacgtctacaatgttcttcctccctcccttattgctgctgactcaaagttacaccgggtaacacccactacgcatttttcacttttgcaaaacccgaaactgaaagacactcaccatcatatccgaaatgtcgactgccgtcccgtctctcggagaaatcaacgctctcaacgtgccctcgctcccgggcaacctgaacacacccaatcagacccccgcctggaccaacaaccctctgtgggcttatgtttccgagacctacaacaccattgccgccaagcgaagcggcctgaacctggttaaccccggcactctcgagaacctcaacaaggaggtgtccaaggatgttttcctcaccaactacttcttcactggtctgcgagccgagatctccaagaccttcagcatgaaccccgccttccaggtgtcccactccttttctctgggctccaaggtgctccccccttacgcctttgctgctttcttcgccaatgacaacttcttcatgcagggcaacattgacaatgattactctgtcgccgcccgaatgcagtactcctggtctaaggagtgtgtctccaaggtgaacgcccagctgcagaacggccagcccgccatgattcagctcgagcaggatctgcagggagccgacttctccatcaacttcaagtccctcaacccctccgttctctccggcggtctctccggtgtcttcattggatctctgctccagtctctgactcccaagctcgccgttggtctcgaggccatgtactctgcccaggacccccgaatcggagaggctgctgtttcctacttcggccgatacgtgtctggcgactgggttgcctccgcacagctccagcagatgggtatggtccaggcatctttctggcgaaagatcaccgacaaggtcgaggctggtgttgaggccaacctggccctgctcggcaagcccaaccccatgatgggcggtgtctccggccccgagggaaccaccaccatcggcgccaagtacgagttccgacagtctgtcttccgaggacagattgactccaccggaaaggtttcctgcctcctcgagcgacgtgtcctccccgttgtctctctgctctttgctggagagattgaccacgttgctaacacttccaaggttggtctcggactccagttcgaggctggtgccgacgaggagatgatggctcagcagcagcagatgatggagcagcagcagatgatggagcagcagcagcagatgtaaatagtagatagatagtgctgtatcaatatcatgaacgatcgtaccatattgaagctgtgaaggtgtgtagagtatgtacgcagactatctaatgattgagatcatgtagctgtgtgtgattgatatcatcgcgcagcgaacatatggttgagtgtattcgtgaacatcataattgtacatttgagatcatccactcatgatctccggtgaccgtagaggctgggcttcttctaaaaacaaacactcaataccatactggtagctatagtacatactgtacatactaaagtgcgaccatacaatggaccctaatactggggattgatggtgattctaattgaatcatacagataattagtgagatgatattactgaatacagaatccactgcaaccgaaataccataccataacataatagatcatacctctactgtacaagtacaagtactgtacaagttcttgtacctttatcgtgaggtgagaactctcagtcccaaatttgatcatacagtgtacagtagaaatgaacttgtgaagagcttgagatgaaactgcagcggtataatacagtaagatcgtagtggtacgtagtagtatcaggctacagcaagctggctctggttctgttcacactatcatcatacagccgccatgatacccaagctctcaatccgcaaatacaattcttattgcagcagtatgtaatagtctatccgctgtttatgtaacatacaagtatgtatgtatgtacatactgtacctacaagtatcgatacaagtacaagtctacgttcgctccatttagtcgtcagatgctagattacaagtataaataagttagagacgctctattcttgagcaagggtgattgtcgggtcctagggggttggaacgtccgagtcgtcaatattgatctccagccaatcgtcatccatggatctgaacttcatggtctcagtctcaaggatgttgttccatcgagcaaacggatgtcggagaccaatgaaggcaacagccgaagctcctgtggtgtagaactttcggatagcagatcgagcatcgataggagatcggggcttctcggatgatcccaggacacctgccgactgcggtcgctggggagtaattttggcaggtaagggagagctcatgagctggcgctggaactcctggtcgggggttcgaggagaaatctgcagctgcaattgcgacactgatcgcttcagtgtcacctgagagagccgctctgttagtttgggcttctctgggaaccgtgcagagggagatgaagcagtgatgtctgatcgtgccagatggtctgaaatgtccacagagatgtcaccgtcgtcattctggtcagcatcctccacaccaaaggtctcaattatgtcatcgagagttgaagaagaagaggcaaacagctcgtcatacttggagggttgcaagtggccagagatgtcccacgacgagtcggaaagagtggagttagcagagtcgaggtcaggagacgattgtagcgaaagagatgagtagggaggagacggggagggagagagtagggaggagtagggagaagaggctgaaccaatagtttccaagtcgtgttcttcggaatcataatgagtagggatagacaagttatcgatctgggaggccagaaagtccatattcagttcaccaccattggtacgcacctcctccacggtgttattatcatcttccacctttgtctcatcctcatccttctccttgggaggaggaatatagcccgagttattggggttcagagacacgagtttctccttgagatcgtgctcgggaatcaactggtcgaggtagttctcaatgtactcttccttggcaccttcctccaactcaggagctttgatttggtccaggaagcagcagctctgctcaagagccatcctcaggtcatcggcaatcttgtaggtagaccggaacagttctacacgccagtaacgtccaggtatgggctgtgggaagatgaattgtgacagagaggttctccacagcctcagcttgggcagaatggcctgaaccgcgtctccacatttgatgtatgtgactttatcgttatgcagagtgaaaacctggaaccgaccgtgggccacgatgcgttcggaaatggcacagtggaccggtggaagttgttcccacgggtccaggttgggatctgcttcgtcgggctctgttagggttgcgccagaagaaatgctggacgcgtaggtaccggaagcgcatcttgagccaggtcgtgacctgagctggacgttggcgagttctgagcctggtgcaaagctggaagtctgtcggttgccctcgagttgctgtgtatgtcgtctcatggctcctgcagggatggaaaactggatgagttgcgacaggtcgtggtcaaagagaatggtacgctcctgctctgtgggcatgtgtagctcccgtttgtgagccaacgtggcgtccaggtccgacagggacggtttcttcgacaacattattgcatggggagtgtcacagtccggtcgtatcctttgggttgtatcttgagacggttgtggcaggggttgttgataggggcttgtgtcgcggcagaaaggaggggcccgtaaatgtacgatagggttgaatgcaccctgtgtgttctagcggggcgctaagggagacttatagggatgccgtggggttgaagagttggtgagtcggagtctcggaaaggtgaccggtctgctgtgtggaagaagtgtgggagaaacgccaagtgcatatccgtccacaggtcgcactacatgtaagttcatgttataattaaacgttgagacacactccagagtcagagtcagttttgaaacgggttttattacacagccaagcacacagtacaaggaccagctgtatataagagggcccttttattatattttcggatgcacaatcgaaatatggcgccacattcgacgttttcgccggtgtaatttcggggtgaggggcttggtagcaccctcttgtgttgagcagaccacctttgccactcccagagacacaaccacactgtacaaacttggtcggactatgcaaaattctccctataatagtctttgtctgcctgcctcgcgatggcccgttaacgccccctgacttgtcccgaacctaaaacgcggtagggacattgattactcccctgaaacgggttacagataaatagactggcatggaccagtgaaaacgtgaaaaattatagcgtctgtcccacataaacaatatatcggtccagcttggataacgcactcctacgagtgtccgttcctatcaccttagccgccacattcaccccaaagcctacctctgatgggagtgtatctccccattctccaactgttcctgcgtgccagccactgccgaaataggtacagtacttgtagtcgtgtgcccatacgccaactcaactgtagatacgaggtccgaggtccgtgtgcgcatataatctggcatgttgtcatcccacctttgtgtgccatcaaattatcccaccatgccccacttttttccactgctagaatcacatggaacgaaattggtgcctgtgggcgtctgcacattggagagctatatacagtatacacctctgggtgtgtatgaactatcggtatacaggcgcgtttgggaggtagcaacgtgttgagccgagatgcaagttatgtgcagaattgtggacggtgataactcaatgtgagcccagcagttcaacgcgagctacgtgaacgatgttggaaatgtgctcaatggtgtggtatgatcatgtcgggtcgtattattaacagtcttggtcctcacgtcgtaattagtgcaaggacgcgtacagcttacgtacagtaccaattaatcactgggacaagtattgtaaaaattactgtatgtacattcaagtgtccacatagttacttgttcgcaggcaccagcggtttttgctggaatcaacaaacagtttggtatcacttggttgtggacggcgatacttgtgctggtgtgtacaatgctgtcgttcttgacacctgcaagcaagcactcttgcctgccaggaatgttgacactggcaccacgctctccacctttttcgagcttggcatgttgttgtttggctgcacggacctctagagattccagtggcatgttttgattgaggatattattaacgggcatagctcggttggtgtttatggtgtgtttgtttgcatggcatgttgagactggtgctgacttcactcgtgcccgggtgtatgcgattattgacacttcccatgctacaagtagctaatgtcgggccttggagcatgacatggaggtatataagagctgggagagacccatgcgttgagaggctacctgtgtagagccctactgggggctcttgggacgatttttcgtcactggtagaacatgtgtccttcttcacctaatactgtaactgctaagttcttgggagacttaaaatcactgtccagcctcctatgggatcacgtgctttgcctgtgcgaggccagttggttggtacaatctagttgatagcagacgtatgtgtgctcccgttttagtgtaccgttcctgatggtatattgcccattcactagtcacgtgacaattattgtcgtattatatacgtcactggcccagtcctcgtggttcggtgcatgagtagctattttacaactttatctcgcatgtcggatgcgccagggttcttgtcgtaataggaggatacgacggacccccaatcgggtcacacctggtcgtatgaggtgagagcggcggtttgtgggcatgctgcatcattttgattgtgttgtgggctttttcccccgtgaaataacttccaccccacttgtctcaggccccaccatggaacgctatatgatcactgtttaggttgtgtagcatgggagttaaattgccacttgcaaccactgatctgctagaaacgggtaacatgacgcctctatacgacacccaaccccacctcaaaggcccaccatccaaccttccccggccgctctcagaaatatgtccattgacccacgatgcttcacatgtatgcggtgtagatgttatgcgccagcaacccaacagcgacatacgcgaggaggggtacgtacatacatgccccatcttgtgaaatcaacgccaatagagcttcatacttgtgattactaacgcaataataccaataaagcagaacctcccaaagtgcggcgttaacaccaaaacgcagtacgaattacactgagctcaactcatcccacatgctctcctacatgtcattcccacagctaatttcttgtatacatacagcgctgaccgtgtagcaggaaccttgaatagccatgcgtgtcacctgtgtgcgacaaagacctgcccccatgacgcctatcatacgcccaactttcccctagaggcctacaaccggaccacgttgtcaccacaactttgcacatccggccaccttccatgacccatcgtgatgaaagcattggctggggatgcagcaaatcgctgttaaggttggttggtatgcagaagcctgcaccgttgggatagaagcaagagacccgataacagggcttaaatgttttgcccccctcttccttggtaccggtaagggtatgagcccaaaacaatgagctgaacacacggtggcgaaattatgttttgaaatgagggttgccagagaggtgccgtacgaccaggtcgccacctactcacggccggatcatttgaccggagatagagttgtacttgctcggagataaagaagcctgtggttgtacaagtacaacagtaggcaacagaaaccacacaagtaggactgccaaaaaacgacacgcgtgtgcatcaccccgtgagcgcaagccaaaacgtctctttgtgtggagagaggagatcttctccagagactcttacactacgtacagagcaatttatacttggacgcatatatagtgttagaatctcgcacagtcctgatgtatatgcagaggcaagagctaatccgttctcagttaaaaatttaacacctcagaaccactctcgttcatacacaaaaccaagttcacgctcatgtcatgaaactacccatactagcctcgctttcaggactagccggtcttttcaccacagcccacgcctttggggcaggaaacattccctcagactcctctattgagggcaagaactttcgacacggagatattgaagatgtcctggctgggattgtcatttcacaccgcggaggcaaggcccgcaaattcgacggactcgacatcaaacgtgtctacttcggcaactggctgagagacttctcgcaggctgtagatgttggcactctttcgatggggctaaacgcagacacggtccgtgcgatcatttggctcgtgtcaatgtccgagtttggatacggaactggcgagttcgaggtcacggaggaacgtctgggggtgtaccgagccgaggaacacatggacaaccccaagggctacccagaggatgctcagcagtacgacagaagactgcgaggtcccgtggatccgcgcgagctagaaattgatcccaagacaggaatgaaaaactacattgccaacgaggatggtgattgggcgacctcgtcggagtacgtgcgagagcagcttctgcgatgcatcaagctcggccgacggtatatcaaaggaggatacaagaaacacagcctgcagcacgagtcgttacgactgctgggtagcgccctgcacacccttgaggacttcacggcacacacaaactacctggagctggtgctgagagatatgggctataaggatgtgtatgcccacgttggaaaccagacgcgtatcaagctggctggaaagaaggtgttccctgtggtgactggaacatttggaggactggacttcctgcactctttgctgggaggtgctcacgattcgctgtcggagagtggattcacagaggcttctgccaattttgagaagaagaagaagtccggctccaacacttcggagtttctcaagagcatcctccgaaagctgcctatcaagctgcccgacattcctgatgcccatgggggattcagagacatgacaggagcagacctagctgaccacctggacgagttacagcacaatgtggaggagtatgtggtgcaccagcgagagcatgatgggaacgatgaggactgcaaggactgtggcgataccaagaagaagtctcgcactggaggcagtggcggaaatgcacagcaaggacagcatcctttggttctcgtggaccaacctccttttaagaacacccctgggggaaccaacatttcgaaggtgcacaacaacgatcccaactacacctcgttagagtcgtatctcgacaacctggatgtcgacgcagtgatccgagcagtgtaccctctattggagttcaaggactccgtcatgtcttccctggagtctttctttggcgactccgattcttctacagcgctcggcatgatggcatcttctatttccgacgctctttcctcattcactaactcaatcatcaacccaatcattaatcccatcttggaggcagtcactgagattctacatgcatctgtcactctgctgtcataccacgatgatcagattgacgtatggattaactcaaagtccaccgatcccactcattctcgactgtctaaggaccattttgcagcatacctaaacgagcctgctggcctcgtggctgcagaggtggtcaaatacgtcgttccctttgtggtagaagcctgggaggatccctctattgatcctcagactgttgtggatgaggcactccaaacattccatcatcctgctcttgcacacaccaagctgcatcgaatcatgcgggccgaggtggatcgatggattcagaccttctctgacgaggagcgagagcatattctggagggccttacctctagaggcgttcttcatggccacaataatgctgagcacttggatgtgaacaacgttacttacgaggacccttttgatcatactggtagtgaagagaaggcctcaaccttccttgattacattgattactttggcttcttcaaccagcagggttccggctctggctctggctctggctcaggcagcatgaagcgggaacacaaggataaagccgaggatgtggccaacgacatggatgctgagggagcagctgactcggaaaagcatcatcaagaccatgctgacacggcccagaagaaggctaaggacaatgcaaagaaaggcgaagccaagcataacgagaaggccaaggccaaggccaaggccaaggccaagcctaagcccaagtccaagaagtctaagagtcaaaagacgcatttccacgaccatgctcaccatgtcgaggaccatcctgacatggccaagcagcaggccgctgagcaggctgcctctgctcatgacgaggagggttcagctagacgaaaaccccaacaaccatagactagataagagtacctacataagcgttgtgcttgacataattccctctctccagtgtcaataaaatatttaatagacgacgactccagtgtatacacatccgatacaaacaagcatacatatatacatattgccatgaacatgggtatctcggaaagaaagcgtgaccgggtttagctctataggatttactcttatcagctcataagacggttgtgtctctccactcatatcaagccatgttaacacacggcctcgaaacgcttatccttatcgacgattagagctcgtccaagggagggaaaaatagccgtgaggggcaaaccgatctattcaggttgttggtaactgccgccttttctgcacctgtttctcattctagtctcgcactaaaatcaacacccgctactggcagctccaagcggggggcatgggtcaagtattggtattagctgcgatagtgtatgataagccaattacgaccacactctaaagggtgggagaactgcacgcgactctctcaaagaggggaattagaatggactcctcgaagccttattccaacccgttcaataatcacccaagcacgggcatgtatgtttatgtgttttcagtgtttcggaacatccacggcagtgccgagataagacttgaggtatgcaggagtgggtcgagatgggtcaaatttttatgcgtgtcaattgaaccctaatatatatattttggttccagaaaagcgaccctactttccgtttctaccttccgtcactacacacacacaatgtcttcctcgcccattccctccaacgtcaacgtgcttccacagacccggcagcttcttggtctctactccatcatccgggacaagaacacctctcggtcggacttcatcttctactccgaccgaatcatccgtctgcttgtcgaggagggtctcaaccagctgcccgtgaccgataagctcgttaagacgccaaccggcgctgagttcaagggtcttgcatttgagggaaagatttgcggagtctccattatgcgagctggcgagtccatggagcagggccttcgagactgctgccggtccgtgcgaatcggtaagattctcattcagcgagacgaggagaccgcccagccctctctattctacgacaagctgcccgaggacatctctagccgattcgtcttcctcctggatcccatgcttgccactggaggttctgccatgatggccgtcgaggttctcattgcccgaggcgtcccccaggagcgaattctcttccttaacctcattgcatctcccgagggtattgctgctttcgctgagaagttccccaacgtccagatcatcactggtgtcattgacgacggtcttgacgagaacaagtggatccagcccggtctcggagactttggcgaccgatactactgcatttaaatccggtctccctggaaacaactcacatacccttcagtatataaaaacataatcgtatatgattgcatacttgtaataaatgttagctatggatcgtttgtgtgtgtgtgtgtgtgtgtgtgtgtgtgtgtgtggagatgatggatgaggtgcaatctaaactggttccgggggctcgatgctggatgaatcaactcattgtagaattgcctggtccttcattcataccctcctcatcatttgccacttctatctgtctttgttgtgaggttggatccagtgcttgtatgtttgtctctgcttttgcttgagcttccgcgtgagcttctgcctgtgactctgctccctgtaataccagattctccttgtagatgcgcaattcctcctttcgaatgtcggattgacggaaaaactcgatctgctcgtccgtcagagtccgttcaactccatcaggatagaagcccagggagggctcagtgtcctcgtcttgacctgcctcatcaaacttgattgtgccctgaaactcgcctagatgtttcttatggaactccagcagatcctgggtcgaaatagacatgtttttgggtggcgaatggtacaataattgagtggccacttacacagactgcatattgggtgttttgattttggatgtggtttcgatagaggagtatcaaagctaatttttctgccctcatgcaaagccaaaaaaatatttgcagctagtgcagatattttggcaggacttcccatccatcttctaaccacacagcatacatcacaatgcccaagtcaaagagaaacaaggtcatcgctctcaccaaggtcgagaagaagacccgggaggacaaggaggtgatcgtcgacgagatccacaactacctcgacgaacacaagtactgctttgtcttctcagtagagggcatgcgaaacacctttttcaaggatctcagagcggactggaagggcagcagaatattctttggccgaaccaagatcatggccaaggctctcggcaagtctgaggaggatgagtacaaggctggactcggcgcactgtctgagtacatgtctggagatgttggtcttctgctgaccgacgaggagccccaggtcgtcaaggattactttgagtctttcgttcgggaggactatgcacgagccggccaggtctctaccgttactttcacaatccccgccggcgttgtccataccaccggaggtaagatccccgctgaggacgatgttcccgttgtgcattctatggagcccactctccgatctctgggtatgcccactcagctcaaggccggaaaggtggagctgttcgccccctacgaggtctgcaagactggccagactctggattctcgacagacccgtttgctcaagcactttggcgtcaccagctctttcttcaaggtccacactgtggcctactacgactctgagaaggaggaggttaagcccttcatttccgcttagatgtctcggaacatattaatcaatcattagacacgtttcaatagaataactatgggaggaaaatattgtagttttacgctgtatttccttgtacagtaatttgtgcatatctaatttgtagtcattttccatgtgggttagctcaaatttattcgacaccttttatgcaaggcgcggtgctgtccattatcaacctcaaaaactttcgaccatgagcaagaaatcgttggccgccgttggaacgccactggatgagctgaaggagaaccagaccatcgccaaggtcgcccaggccaagggcagcaacatatacgaggtgactctgcctcaagacttctacaagagccacgggttcaagagcccagaggtccaggttgagatgccacccaagttcagacagaccgtgtgggtcaagcggggtggctttgttgttgttgacgtgactcccgatgacaagattgccggtgatatcatcgagatcgtggtggacgatcgcacatggcgaaaaatgccctactggcccgccgagttcaagaaggtcggtggatggcagcaggattccgacgaggaggaggccgatccctttgctcttcctgacgacgagtctgatgaggaggaatacgaggaggagcagagttagggggtgaaggggttctaagcggtgtatatatactggagatgatatacagttggacaccttctctctgtcacacgacctgacgcaacagctagacccatgtcagagtcgttcaaaaactacagcatgtagctaatctttaatacattcatataataaagcacacttgcaattgtactgtaatgctttaaagtacaggtaccaacagcgataagcgtgaacagaaataaagagtaagccaactgctctatgttctgatacacgctaacagtacttcacgctacacgacatgggcacgactacgaggtccgtaacttggtatacaaagacaggcgcagatacaataaatgagcggctacgcgttacacacggctgtcctccgcccgacacccatcaggccctcttttcaacaatatattcatgcagcacaataaatacgatacttctatacgtggcatgcggggttaccacaagctccagccgtcggggcctcgttccagctccttgatttcggaaatgtctccattggtgaggtgtccgtagatgtgcgcaaacttttcgtttcgcgatcgcacaaagtcccactgtagtcgacatccgggcttgcaacccacggcaccctcggttaatggggcgccgggagtgtcgggaatgtcaatcgccagcagataaacgcggtcgtgcttgttgaagtacttgttgagcgtctccagcagctgagccttggtgctaaggtggatgaagccgtcctggatatcaaggggcacgccaggcagcacggtttcggggttgacggtgccgttctgaacagcctcggccggcaaggattccagaattttgtagatcatggctgcggtcgcttgagatgggtggttttttaaaaagtcggtctttagaaaaaggcagactaataatctccttggtgatgtgtagtgaggtgggtggagtgaatatccaaattagacttagacggattatagtgcgtggtgcacacacccgctggaatgtgcctgctgtacctttcggaaaatgaaaatcgcaaagttaatcagctcgcttgtgtaaccgagctgtaactgtatggactgaagtggggcgggtggcaccagctgacacgagactctgacacagcgaacatttttaggactaccgactcgagaccttatcaggagaccccaagactctatcctgccaacaagtctgtttcagagttctcaaatagctttctcctctttgctggcttgctgcacggaataaaataacgcccatcacgcagcatacatatatggtgtcatttcctgtgagaagtgcggtacaagacaggaaccaggcatagcagccaattttttttattgcaacacttgcttctattcaataatgtactgtttatattattacctaggagtggcgtcgattcccgcctctccttgatttacccccaccacatgcaattaatccaaaatgtagttacccaacttgtccatcttgaggttctcaatgcctcgctcagcaatggccttctcgaggggatcctcctcttcttcctcctcttcttcctcctcctcctcttcttcttcctcgtcttcctcgtcgtcttcctcctcctcaatgtcgtgctcctcctgatcagcatcctcgatcatctcagcgtcctctgcaagctgctcgttctcctcatcgtcctctcggatctggtcgtcgacgtcgttctcgtccacctccagactctgggccagagcggcctccaggtccttggactgcttcttggagaagccagatgcacccaccagcttgtcgatagcctcaccctttcgcttcacgtcgcggtcgaaatcgggccaggtcttggacacgtagcccaacttctttcggaaaaagagcttgatacactccacgtctcgctcaaagtaccgtttggcgtccacgtggtcgatggacacacactgagggaaatcaatgacgacaatctcggacttggggtcctttcgatcaaagttttctctgatcataatgttgaactcgttgaagtcgcaatggattagtccgtgctgtgccaggcgcacaatgaagtccatcagggtctggtagagtcgagcaggatcatcgtgctcctgcagttgacgcatggggaaaccgtcaatcagagacatgacaatctgatgtcgcgactggtcgatgggagtgggcacctcgaagccctcgtcgtgcagagccttcatgaaggcaaactccttctgagctgccagacgagacaggtacatccacgatgcactggatctgttcttgaggtaatctcggttgttcttgacggttcggaacgagattcgacccagtctgtggatcttgagaactcgagaagttcccttggcgtcactgacagccacaatatcagactccttaccaataccaatctgggctccgacggagaagactgtatctcgcttgatgaaggccttgagtgccagataatcgtagccaccatatgtgagtcggtagccgtcgtacttggcgttcttgacccgggcaatcagaccggccttggccagatcggaaatgcttctgttggtggcactgacggatttgagctttgcgatttgggtgatgagcttggtgggcacgacctcgtggttcttggagcccatttctgcagccgtcaacacccgaaagtcatcgggtgtgaggtatctcatggcagccgtgttcaatttcatcttgtctgtatggtgttgtactgttgagctcgagatattggccgcctctataaaaatattttgtgcataaactttatcgtcggggtagagtggcggattcaagacattacaagatgagttataattgcactggggaagatctgataagagatggcgtagtttagaatagcgaggatgacaactgagtctgacggtgctctttatggggcgtattgggtgaatgaaaggtggctatattggggatactcaacattcattactactaagtaatgtacttggaaagggctcatatacacttgacttacatgtaaatccaagtaaagtgtgaagtatcccgtatggttaatataactagctgcgatcagtctgccatactgttggaaataaaaaatattggacatcacaacaggcacacgtacatactcattctgtacaacgtacaagtaagacacccccaaatcaccaactaaacacaacgaaactccattggtgacgttttgtggaacattctagagtcatgacgtgaatacagaatcctgccttacgctacaatacacacacccccattcctaagtcacatcattcacattcgccaataaattaattgctttatacaagatgcacgggagtcatcattgacattttcttttgtttttccatcatgttttcctttttttgcgttgcccaatcctcaataactcatacctatcttcgcttagatgttagaagggtagagcatgattcggagagaagagccgaaggtcttggcaggcaggttgtgtcggaatcgggctcggacggcgccagagttaccgtgagttcggacgatcttgccccagatgactcggaccttggtgcctcgaatctccttgtcggctcggtagacgtaagccactcgctttccgaggtagaacttggcctcctcggggttggagacaccctcaatcttgacgagagacacgttggggttaacaacacgcttgcttcgctggtaagacaggtgctttcccttaacgtagacttgggttagtttttgcacattgaacatgtttgcgccgcgttgttcaactagagcatctccaaaggccaatcgcatgtccccggaaacaccaaaaacaacgcaacaactcgtagttcgtcttttgggcgcatttgcagcccattccgtcaataatactcacgtctggtggaggaagtcattttgtgtgatgtggttgattaccttgaaaggtctgaaccaaatttcggtatgataagagtgtgtgcatggattcgtcccaaatgggtttcccaaacgggttaatagatcatgtgatcaaaatagggttaaccctaacagcgttagggaagaactggatgatgatactgaatataattggtggggtttttggtgatttttgattaccaccctgaattattatttcttctgattttccgatcacgtgatagaacactgagtattcttctccgtcacttacaagtagtcatccctaatacttgtgcgatttgttctatgatgtacttactgtacatacttgtagttcgtcctgcggctcagaaattaactcatcccagcttagtcacccaccagctctaccaaccacatcacatgactgatgcttccgttatcgctaaaaatcgcctgattagataaagttaattaccccataatgaaagtcggttattgaacgatctacaactgccacgacccgaaccaatgttccaaaactgtgaacccgccatggccaagaagaattatgtggtgattgggtgagtctagagggagggagactggagagagtcttttcaatggtattcaacaccccacattcatccctctaacacagatctggcattgcaggactcactactgctctgaccctgtccaagaaacccaataccaatgtgaccatcgttgccaaacatctgcctggcgatctctcaattgatttcacatcaccctgggctggaggagactgggactcgtttgccaagaaggacgagatcacgcttcaaaactacgacaagcctgcgtacctggagtttctgcggctctcacgagaagttccagaggctggaatctggatccgacaggttactatttatttccacgacagagatattcccaagaagaaggacggatctctcgataccgacgccgtgactccctggtatagcacctttgtggagggttggagaactcttcgaaaggaggagctccctgagagagtggtctggggctacacattcacatctgtggtaatttccactactcgatacatgttttatgtacagcaggaatgcgtcaagcggggcgtacagttccgaagagctactcttaagcatgtctgtgatgccaaaaagtacactgccttccctggaccagtagacgccgtgttcaactgctcgggactatctgccaagtttctgggaggtgtggaggactctaacatgtaccccattctcggccagactctgctggttcgaaacaggaccgagagactgctcacgtatgtgtccgtggatggctacgaagacgagtgtctgtacatcatgcctagagccgaaggaggcacagttctgggcggatgtatgcgagtcaacgactggtccactgaacctgataaggctctggcagaccgaattgttgcccgagcaactaaggcctgtcctgagctgctggatgacggtcctctggatgttgtttctcacaatgttggtcgacggccagctcgacagggcggtcctcgagttgagaaggagaccattgacggaactgtcgtcatccataattacggagccggtcccgctggtttccagagcagtatcggtatggccgaggcagctgttgatctcttgaaggggtcaagtaagttgtaattggcaacttttcacacgagtaacatcactaatggattatgtggatctgatataacctggagcagtggacattaatgatacggtctgtgtgtttacatgtgaacttgatagcggtactactcgtacatactataaatgtcttgaatcttactagtagttactgttgatcaattttgagcaattgaataataaaaactactatacgtgcttccaatttgttaattaatgcatatatctacatatcatcggtccacttgccctgcttcttgtagtcagcatagaggactcggatgaaggatcgcgatggaccgtccatgatggagttggctagatccagatcttccttggtaaccagctcaaagatggacgacatggcgggtcggaaagccactgtgatcgcggcatccagcttctgggttacgttgatgtgagcgtaggcagccaggaagtagatcatgtgacgagctgcctcctttcgagcagcctgagtggctgacgtcagagacaccttggcagcccgggtcttggaaagggtatacgcagggggctcacagatgagttggacggctcgaacgagagaatgaacgtcctccacagccacctcggtgcccttgaccagtacactcagcagagccttcaagctgtatacgatgagcgagtatcggccctcaatacggggtctgtgactgagcagaatctgggacagaacctgagtgaatgcgacaaatgtgtcgggagtggcctgagactgcgaaacaaccacaagtatcaactccagacagtattgagaaacagcccagggggcacgtttcaacgtagaagccagagctcccaggaaaacggcagactgctttccagactcgacatactgtgagatggcagacacaatgagagaagtaaagtctatctcgtgatgctcgtcgtacgataaaactcggatgatgacctcaaatgcgggataggccgactcgccgtaccgaacgaccatgacaaagacgtttcgcaactcctcgggactcagagactcgagatggaaggaataccacttagacagctgttcatttccctctccaacgcaaaggaatagagcagtgatggctaggttgggtttggagatgcccattaacaagctcgcagcagaagtcagcagagtatcttcttcatgctctgtcttggaggcgacacgcttagagatgatagaagtgagcttagtctcgacctcatctgaatcagacgaagaaaagaccttgactagagacttggtatcgttcagaataggttcaaggtctgtatcgttggactcgagaataatagtcttaagcgactttcgaatcgacttgatgaagttagagtcctcgtccgacacaattcgagcatacagcagagcctgctggatcgacttattattcttgacgttcttcttgagcttcttttccaatgtctccaggaactccttgctggtatcttggttcttggtctgaacatgagacttcagaatggtggagcagatagaagtagatagagctgacccgtggtccagaagaacacagaaagagtcgacatccttctcaatctcgtaaccacctaaagtagaagatgtgacgagcctcgagacaagttccaggccctcagcggtagggttctctagagaaaacttgttgacgagtgcaattcgaatatctcgagggaacgcagaataaggaacaacagtgagaggcttggggtccttgatattttccaagacaggagtccacacatgggtctgctcgaataactggtcattttgaaccagctcagtaacgtatgtggagacagccatctcggcaatcttgcagagtcgtttagacttggcgaaacggttgagaataaccagccatcggtcaaacaagaagggaatcatgccatccagcttcttcttgaccatgtacgaaagatgcttgtcaagagccttatcaaacttcttaacgttgtcaaactcggcaagtcgacacagacatccaaactgatatctgaatagctccttcttaggctcaacagcttcgttgaaatcaatcttatgcttagtgttgggtgcctttgtgaaaatgatgtatcgcagacgccacagtgtctcgctatcaatcttctcatcctccagcttgatgagcttggaaagaaccttcaaaaccttctcgtcaaaagacgcctcaagcttcataaacagaagagcattgacaattgcaacaagagcataaagctggttgtttctgacagcaatatctccctgctcctccttcaccttccccgtccaatgagtcagaacatcgtagtactgatcagggaacattttagcaatgagatcagaaacatagggcaggaaaccagggtctctccacttactagacttggccatctcatccacccagatgatgatgaagtcatacatgttgctgttgagctggtatcccgtagccatacctcgcatcaccgacttcgtgtactcgttatcaggaccatcagagatatccttggccaaagacaccgaagtagctgtaagtgaaggatcttgtcgcaccaaagcagcaatcagacgccaatctcgttcattgttcacctgccaatccaatgcaaaggcctctctcgtaggcacagcctcgttgaaaagcctcaccaaaatgctcttttccaccttgtagcccatctctgtacactgatccagcagctccacagtgtactgcttggcattctggattagaccactgaccagaggcacaaccagatccttctcaccagtggttccaggcatagtagcagccaccttttctcccagtctgataatgtgggcatagcctcgaacaggagcctcagtggagaagctcaacacctcaaaagtagtgaaggcatacagaccagtgatggggaagtgttcgggatcaaacaggaatttggtgaccagataatcgatgaaatgtgccaggtccttgtttagatcctccccgtccaatagatagaaaatgtagggaagatacgatccaacctctcgacacttcttctgcatatcctgacttccctgagaagaccgctccaaaaagttgaggatcatttgagtccatgaagacactccagcaatgtgtcccacaggcagcccggtcttctgaaagtttgtaagggtcttgaggtagtctcctgcgatttcgacagcggcactctctgtaaactgcacggctaacgaccgagacaccttgttgacggctgtggtgatctcgtccagcagctgaacggagcagccctcaatgttttccttgatggctagactgacgatctctgtgaacttgctgtttctgtagattcgttctcttggcatggccagatccttggccatgtcttcccacacagtgatgaatagcgtccagaatgccgggtctgctcgagcctccttggcagagtcggtcttctcgcttattttgtccatccaccattgcaaaactgcgcacaaccgatggggaaagtagacgttgaggtttccggctacaatttcgtttgcaaacggcagaatctgcaccagaggcacgcccttgcgtcgcagatgacgcgatatcgatgctgtagtctgtgttagcggtggatctcgagtcaatttagccggtgtactcacttccatatcagccatgttgttgttatctgggtctggtgttgggtgcacgaaatttcctactctgcatacaggaatttattaggctctggagcttaaataaatattttcagggtgggtgcattaagcagattgtaaatgggacttcaaaaaaataataccactacacatatcgaaactacacacaacaaaatgaaatcactggaagagctagaggacgccaccgaaggagtcatggtggacattgacgagcatatggaggactccatggacgtggactcttctgatgacgaggtgccggataaggacgaggaggagctggagctggagaaggccgtctttggagatctagagggctttgagatgggtatcaagaacattgcgcttgaagaggcagaggaggaggattccgacgattcccatgattcggatgacgagaatgattttaacaagatggaggacaaccagttgttctttgttgatggaggagacgggcaaaagtaccactctgatgacgactctgacgacgattccgactcgtccatggactcagataccctcgatgagactctagaagagcacggaggacgtgccgcatgggccgactcggacgacgagaacgtgcacatttcgctggtgggagatcacgatggtatgctcaagaagctgcgaaagacgcagacccaggactacgttaacggcaaggtgttttcgcgacggctgagagaacagtatagaaagatctaccgggtccccgactgggctgctaatgcattcaaggccaaggccaagaaggactacgatgaggacgactctgaggggtccgatgaggaggagcaggacgtgcttacaggcacttctctgagcgaggtgcttcagcgagtcacccagtactccaacaaggagtccaaactgcttcgacacggcgaaatagaggttgctcgacttcaggacgttaactttgctgctccttctcgagctgccgtggagggtctcgctttccaccccacacattctctgcttctgactggaggtttcgacaagactctgcgactataccaggtggatggcaagaacaaccctgttgtcaccacgctcttcatgagacatactccctttgctcacgtggccttccaccccgacggccagagagtgtatgctggtggccgaaagcagaagcatctgtacatctggaatgctgagagtggaaaggtggagcgaatggcacatctgtacggccatggtgacaaggtgcgatgttttgcgcagttcaagctctcaccagacggaaagtacctttgtgtagttggagtggacggctggctggccattctgtcggctacctctggacagtggatcgacggctgtaagattgagggcgacgttgccgactttgtgtgggacggtggctccattattgctgtcaacaccgctggacaggtgtgggaatacaacgtggaaagccgttctttcacagctacttggaccgacgagggaggagttggcatcacggtgctggctatcggcggcaaggctaaccagtggctggctatcggctccgagtccggctacgtcaacgtctacaaccgacccaaacttgcattggagattgctaagggccaaagcccctttgtgccccagaaacccactgcggttctctctaacctaaccacccccgtttcgtcgctagtcttctctcccgacggacagatgcttgccatggcctccgaccagaagcgagactctctcaagctggtccatgttccttcgttcaccgtgttcaagaactggcccactcaacatacttctgtgggagttgtcaccagcgtggccttctcccccagctgcgagtacctgactgtaggtgccaccaacggcagagtccgaatgttccagctcgcccactacaagctttaatagtatagatgcatattagaagatgtttataagagaatctgagtagaagggtaagtgtatatactgggtctagttggggagcgactgagtactttttacctacatttcgaagtaatttagtaaacattagttgcacagtccgtttaaaaactctatctaacttaagctcatctatcgaaatatttttgcccgacatgtaccttaaaattattctgccaaaaagtatacctacgcatttcatactcatacaccacttacaaaaatgactacccccgacctggaggataagtccttcgactcgttcggccttgatgacagactgttgtccggcctggctgcctgcgacatgaagcagcccactctcattcagaacacaaccattcctctggctctggacaagggcgtggatatcacagccaaggccgtcactggtagtggcaagacggtggcctacttgctgcccatcttcgagctgatgctgagagctgagaaagagaaacgggatatccagactgctctgattgtggttcccacgcgagagttgtgtgagcaggtgtccaaggtgatcaccaagctgacccaattttgcccccatctcaagtctctcaacgtgactcagcagctcggagacgacgttatttcttctctgttggaagagaagcccagcatcattgtcggaacaccctcgaggctgctaaaatacgccaaggagatggactgctccaaggtcggttatctggtcatcgacgaggcagatctgctgctatcctacggctacaaggaggatcttatcgagctgtcggagatgctccccaagactaagcataccttcatcatgtctgcaacactcaacaaggagtccgatctgatgaagcagcagttctgcagaagcactgtggctagtgttgcagtcaccgctgctgaggaggagagaaaactgctgcagtactacgtcaagtgcagcgagagagataagtttctgctggcctacgtcatgtttaagctgcagctggtcaagggcaagaccattgtctttgtcaacgagattgatcgatgctaccgattgcgtctgttcctggagcagtttggaatcaaggcctgtgttctcaactccgagctgcccatcgcctctcgtcttcatattgtggagcagttcaacaagggtgttttcaacttgctgatctgtaccgacgaggccaacaagctggctgaggctagtaaatctgcatccaagcagaccaaggaggtgtccagagcccatgagtactcttcaactcgaggtcttgatttcatgaacgtggcttttgtgctcaactttgatctgcctctttctagccgagcatatgtccaccgagtgggccgaactgctagagccaacaaggccggtaccgcactgtcttttgttgtgcctgccgaccaatggggcaaggataaggtggccaagctggatactgctaagcgagatgagaaggtgctcaagaagatcatcaagaaccaggagtcacagaacatggaaatcaagccctattcgttcgacatgaagcaggtggagggcttccgataccgaatggacgacgctttccgagccgtcacaaccgtgggtgttcgagaggcccgagtcaaggagatcaagaccgagttgctcaactccgagcgcctggctcgacatttcgacgaaaaccccgacgatctgaaggctcttcgacacgacaaggagctccacacatccaaggtccaagcacacatgaagcgggtgcccgactacttgttgggacgaaagggtaagctggatcctaatgtgtttgtgccattcagaaaggatgataacaaaatccacaagaagtataccaagaagaagaagggcggcgatcccctcaagttcaagaagcgaaaatagatgatatagaatggaaatgacagattacatggtattgaaatagcgggtgtctgctacaagtaagcggtgtgttttcaagactacagtacacatactgtacatagatatatgctggtgttggttctgtaagtgagttgtgttatagtcacttgtaccagtagtaaaaacttgtggtacagtatgtatgtatatacagtatattctaagctattctatatttgtattggtacgctactgtacatgggtaggtccggtccaattcttcgtatcctcaattaatatccgttattaaattatgttgtgctttattcctacttggaaacacttctaacccagtattcactggcaccctcctctctcatcttaatatactgacgagacaacagcaggccgacttggtacagttctcgttccacggcctgcttcttggtttccaggtcagccagattctgggtcagattcgtcgacctgcctccagtgttggcagagaagtttttgtatgtcgtggtcggccccatcttcttgatgagatcaatctccactgtgattgcacgtgacaactcaaacagcttgtccgactgctgttgcagctgggccactcggtctgcccgtgatgcgtgcgactcccttgagctaatcgatgcactgtccgaggcggctcgtggcttctcagctgcaatgcctccatgtccttccttcttgctcttgaccgtctgtcttaccaaagcgtcaaactgtcgctcgatctccacctccttcatcttgatacgagcatatactccggagggccccgagttgttgttgggtttcacctttgcccgtgggtcgtgcgtctgtggtcgaggagccaccgtgggctgttgtggccggtgaccgagaccatgtcctatgcctgcattcttgtggaaaatgccccgggtgcctgtactaggtggagccagtctagctactgtggcaacgcacacctcggctgaggtgtctggcgagtctagagacacatctccgtcttcctcggcgtcctcgaagcggtccaggtctgagtctcgaagtgtagatgtggaggaggagttctgtaaactcttgttatgctgtgtagttggtgcagcccgttgttgggcatgtgttgttgtcgtggtctgatgatgtgtgttgaaagggacagggcttccagaaggctgtctgggctggttcagcttcttctctggagtcgacgtgcccccggcggcatgcaaaacgtcttcggggatgcaatagctctcgctggcgacggtgttgagcgtggaggacgagtagtttggcaccgctctcatgaaagctcttcggcgctgttccgacatgacaaaggactcatcacgggtcatttcgtagtgcgacgtgtcgtcggcgccaataacgagggcggctcccacggtttgggccattggtcgtgatggcatcttggttggggtttacgtctcgtctcttcaatctgcttgtgatgattgacactctcactgttttggattcagagcgcgaaacgcgcctttaggtttcaaatgcgatgaacagagttggttcccctaccttgaatcgctgggtgttaaaaccaagtcgtataaaccaccctggcaggtgttgagagaagaataggtgagactcgtatgtagtatgggagagagagctcaagaggcattatatcatatagcaggtctggcacttgacctgcagcatcgcatcctgcaggaatccatcacctgggtcttagattattattctccttcccatgcaatgttgtggttgtattttgaaatgttattctgagacttctgtcatacccttttgagaagtcggggttggggtagcccagaacttgcccagaacctgaatagccatttgggtcacgcgccaagtgcagcagtcatgcactaacgtttagttcctaaaatttcaagtgcgtttttcaggcgcaaaaaataaactgaccaagctctataatgcagcgactattgaaaaaggcactgaaaaacagcgcagcgggcgaggctggagcaccactggagcgcaccgacacccgctcctcgcacgaaacgctctttgacgacaacaagtccgcggtctccacgctgtttgaaacccctgaaggcgacccgcgagaacgggatgtctacagcatatactcggccatgtttcgacatggagtgaccgtttttgacgatggcctcaaaaaacccattctgtctgtgtccacgcatttcttcggcaagacctacatggagatttaccggctggacgataagcagagcccaggtagcgaggctgtgtcaatgtctggaaccgagtgctacaagtcgcttctgtgcagtgtgacacaaaaggtacttgacaacgaccgtatcgagtacattctcacctttgtggacagcgagcgggacaacatcaccatggttacccatggaaccaggcgggtgactacagcttcttacgaaggcgtgcagttgcaatggtacggaacgacgggcattgccaacacttatggctctggattctttcatctgcggcttgttgacaccgaacatactgagagacagggtaatgtgctgccagactcagacaccctctgtggtccttgcataggagcctacagttatctgactgagggcagactgaagaagcagcgccgggttggcgagtttagcattttcaatggtggcactcatctttccgaggtcatcctactcatgggactggttctgcgagagggagagatgcgaaagataacggaaagtacacgagctgccaatgctgtcaccagcaaggtgtttttgtaaactgagtgatgaaaacggcatggttgaaacaatagtttggtagctaccgtgatgagctccgtctcttgcgacaaccaggatagcagcttgggcgggaaaaagaagaagaatgtggattgtggtggctttgagtgccttccgccgataatgtgaaacgaatttttattattaatgagtaagacagacagactaatatatctgaatactatggttggttgcctagggttgtgtggatggtcgttcccgttcagctcatggccgaatcaggtatactcgcttacataatcattttgggttgcatacaggcatctcggtgaagcatgattttcgactttacactcgaccgtcacaatgaactcctttgccccggaatgcactaaagccaagaaggagtacgacaactgcttcaacaactggtactcggagaagttcctcaagggagagtccatggagaacgagtgtgccgatctgtggcacgagtacgaggattgcgtcaaggtgagtagggagagggagagggcagcctggagatgaattaggatcgattcaggagatcggtacccggcgtaccactcacagtatttactaacccaggccgctcttgccaagaagggtgttggaaagatgattgacgaggctcgaaagcaggctccgtttgagaacggcggcaagctcgtggaggaggatgaaaagaagaagtaaatgtatatattaattgaacgattctgctggccaagatgtgaaaaaacgagtttctcacttgtatcaagtctgtgttagtcaggcttttctctgtaagtgtgcaagggtgtctgtgagttacgggtgaatttttttaaaatctagtaaaaggatgaagttcgacagattttatagggaaatctaaacactttctaacgatttataaaaagtcctctcgccgcaagaagtcatcggccaccttccagtaccccaaacacacctgtgtaagtcactgcaagaaaacctcgccacgtgacaaacaaggttttgcaaaatcgtcggttggaatatcagactctatcaccacacatacacgaccatacaaaaatgctgtctctgattcagtcgctacggccgactgtggccatgaacaacgtggcgcagatgtttgtgcgaaacacttgcaagtccgcccatgtcaagaccaaaaaggccgttgccaaccgaatcaagatctgtggtagtggaaagatcaccagagtgagtgccacaaggatggagaggaggggaaataaggaaaaaggaatgctgggagcgactccgatcaagccatgatagagtggatagctgatatttcagtgccggaaaagttttgcctctgatctgatcatggccttatgttacacagctttcaagctgagatgattaactgtttcagcagctagaagagataccagacacggaactacctgtcacaaccaggctgattacgcacactgcgttttttttgttttttttgttgcttaccaggcactcagatcaagcaagacactcataacctcttgtagctgaacacatcaacaatgacaacttccagatcgccactaactcagggaaaaaccggacgaaagcacggaaacactggatggtccgctgctctgctgcgaaagaagaccggtatgaccgagctcaccggtttccagaagaagcatgtcaagaagtacgtgcctttcaaacaatccccttaatgtatatagcaattagaaccctcttggatgcacgagaagtctgtacagtacagacggatacaagttcgtagtgcacgtaccgagctgtttaaattaattgatgtatttttctgtataagatgtaatcattgcatactctgcaaataataaatagggcgcgcggggtttagatcacggttttgatgggacagctaggccgtgggtaggtacagcacttgtactcaggccgtggtggagacgcggtactgcgaaagtaccagcgatatgaatgtcgtaagtatcatactacaattgtagcagaggggggttactggccaagcaacaaccaaccaataaaatagacaccataacccatcatttcaacagcatccacagggttaaggctggacagaccagagtcccactcaatggcagactcacgaggagcatactcttgtcgatctgaagagggctcgttggccaaaagaccgacatttttttcaggcacaaaaggcttgagctcctcgccagtcaaccaataatggagtcgatctccaaatgctgaggcgttggactcgcggttgcactgttcaatcacgcttgtcactaattgttgtttgtcggcgtcacagatatcgagcatttgtgtttcttgagagtgttttctgattacagcggacccaggggcgcttttttgattatatatagccttacagcctttcagagactttcgtcgccatgcaacaaagacaggaccagtaaggttgttgagtgcacgtgacctcgggtccacgaacgtcatggggcaaaacaagactattgcaacataattataaggggtagatgcagcttgcgagttcccctcctgcttgctacgtgccagtgcaacctctggcgtgttattcttccacatttgctctttgtggcgaccagtagcgtgtaataaacattctggggtaactgtaagcgctgatatggaaatgtacgatacgatagggtatgtagggtccatgtagggtcttacagatagcttcaacaagtactcgtaccaggcgcgatactgcaataacagtggatatttctcaacaaatctactgtaggtgacacacacactcacgtctgcgtctccacatgacaagcatcactgttaatctatgttccacttgattatggcttttgccaccaggtcttgttgggtcatgtcttgtgtacttttagctctccatataataaatatattggggtaatcctcaaggtggagaatgtggggtgcctgaatacatggagtgaaaagtcgtgtgaccagttgtcgttggcaagatgataagatcggtgatgagtccgagcacttaattgcgcggtagtgtattgttctacaagtagcacaacatgtcatactacgattactacagcctcactccacactacataacgtacagtactgtacttgtacccgtgccatagactacaaacaataacacctctgtaactaaacatgcaatctatacatttttgggtctctatttactcttgcttttcagcctcgttcacctgctcctcgacattttcatcgctctccttgactcgcttaccgtccttataactgtatccaacccactcattgccctcctttttgatctccgccgtggggaagtagtggtagttcatcttcatggaacacgcaaacgccacgttgtcaaacgtgacaatacgcaacttgacgtaggtattgtcagggatcttggtcaccacagacaggaacgtctccagatcaggagtggcggtgccgttcacgtgagtgatgaagttggtgggcgcaatcaagtactggtaagcgggagatccctgggctcgactggacacgtagacgcccgagtggatctttttgatttgctgacgaacagcatggtggggggtctgcagaacagctccgcaccagaagacggcctgagaggtctcgaaagccgaatccgtggtgggagcctggatctcctcctcctttttgtttcgcaccagcttgatggtcacctgctccttgtcgccggcctcgctgagcgttgtcagggtcgtcagcagcttgccgttgatggacagcagaatgtctccctctttgagcgcctgggagttgccattgatgggtgtagcggttcgaatgacctcaaacagctggtgtcgctgcgagttgtcctgctcaacggcagcaatccactcgggagacacgcctcggattcgagcctggatcatggacacagaggcgatctcaacgtccaggaaccgctcctggggaggctttccggctcggattcgctgcacggtctccaggaaggtgctggtgtcgattccgagtcggtactcgtgctgacggccctcggttcgctcgcccatgcaggacagccagaaggctcgcacaacaccagtcttgggatcagcaagaacaccggcagtgcagccattgggaatggtggagtccacggtgatggcgtccaggttgagagctcggtagtagggctctccggcattgggagggatggtgatggcggtcacatcggacaccttggttcgggtggtcaccaatcgaagagacaggttatggcccatgaacagcacagggtctccctgcttcaggggagtggaagagagcttggcggtctcaatatcggcatgcaccagcttggggtcgtactgcagaatggcatagttctgcagagggtgcatgaagacgacggttccagggacaaccacggactcggcgaaggtcacggacacgttacaaagatcgtaggggatgatagatcgagacacgagcaccagacccttctcggcatcgaccacgagaccatgtgactgtcgcatggttcgggggaagccgtcaatcttgtaggggatcatacaagagacccgaacgaaagatcgggacaaaggtgcacacgcagcatcagcctcctccagattgggatctgtgaaggtggctcgctggggcacaatttcgtccttcttgggtacagggtactgtttactgagatcggtgaagtcccacttgccggtggtgtcgtttcgcaccgccagacggaagctagagtgccacttccggtcaatgtaggtgatggtgaagttggtggtgtgtaggtctctcagatgtctgtatcggatcgaaactcgtcggccgtcgggaatagcggcaattactttgataaaggtatcaagatcgggagtgtcgatatcatcgatagaatcgaccacccagcccttggactcattaccctgtccgtcaagtcggaatgagcctccaacctcagacacgtagacgccgcgcacaggaattgcgtagattcgagccagctggtatgacaggtcctggaagctggcaccgcaaacctcaacgtatcgatcgggggtgatggagtgcaagtcctgaacataaatgtcaaatgtgatttcggcgccgtttcgctccacagtcaccttaacaatgtctcccacagcctcgtcgagaatggaatccagggtgatgaacgaagagatgggcgtggaatttacagacagcaaaatgtctccctccagcagaaggggggccatggcagcatcttcttcagccacaacaaaggattcctcgccagccatggagatatcccctccctcagtggctgccacctcatcgtcctcaatagtcttggcctgctcctcagaaacatcatcgaccttgactccgttgactcctcggggcacagcagaggggccctcaggaagaacagtctcggcaaccagcatacctatagtgctggggaagagttctcgctgcttcttctcgtttgacgcacttagacccagtcgtcgacactcgtcgaagggcttcagcatccagtgggtctggatcgtgcctcgggtcaccttgtctcctcgcagaatgcactccagggctcgctttcctcggttgagagggaggaagaagtcagtggatgcgtcggtagagcctccagcctgaagagcaatggcatctccatcgatatcaacaacaggagaaccagaggagccaccagatgcgcttgcagcggcctggatatactcggtgttgaaatcgttgtatgtgaggtcaccgtagtcgggggcgtttctgtcgagccgagaaataaagccggaaagaatcgacagcttttctccgttgtcattacccaccactcgaatctcggttccaacctgagccttttcggggcacagacgcagcttttgcacattcatgtacttgatcttggaagggtcgaacttgaggaaaccaaaatcgtggacggggtctcgatagatgggcaccagctcacactcctcgtggttgtcgaacacagcgtatccacagaagggaccggctcccacaacgtgtctgttggtcatgatgattcccatctctgtatcgaccacgaagcccgtggcttcactgaccacggcgctctcgcagtcgaaagaggccacctgggcaaactggatggatacgaccgacttgacgaccttctcaatggtggagtgccatccagcaaccactccattcgaagcggaggtggcggccggcatggcaatttttttaggactcctgactggcgatttgagcccgttcaggtcgtcgcgagatcgcttttgcggaaccatactgaatcgtcttatgggtcttaggacaaggggtctattgctaacccttagagaccgaaagaagctgaaaatggttgtagataatacagtcttagctggtgactgaaattaggtgggtcagacctggcaaagtttattcaatttttcaaccacaaaggtgtcacatgacccgaagcggtctaaaagagagggctccgacagtaagagacaagaggacggtacgaatacgttcggagggttatagagaaggtttcattttgtgagacacagcgccgagatgaaaagcgtttcttgtgcattttttttcgtgtcctattccatccctccaactatcgctccaacctccttttcactatcgtacacatacagtacaagatgcgatcttgtcacaaaccttttttgcctcaccactctccgtatccatcccgtgagaccatggatacccctctcaacccctacccattatggctactcatgccgtctacacagtaatacgaggagactgtcttatccaattatctccttaagtaaatagttctgcacctaactcttgattagtaagctaacttgcaggctaccactgtacaatctcatgcagactggcaaacgccaccgacattagagtttcaatggtgtacttgttacaaacgagacgaacaaaagctggaccaagatactcactaacacaccatgctggtggaagaactaggccgacagacgctccagagtgtgtcttacagcagcacgggttcaggcagaaaacggatcgccactgctcaagatgcagccacccagtcttcaaccaaaactagagctattgcgagacggttgaacgagctagagcgtgaaaactacaacgattcagtaaaaatcgagccaccacgcgacatttactcgcccaacaacgcaaacaaaaagggtactgctctcaagaagattctggcgtcgaaaaagacactccagaacttttttgatgaagatagccagggcgctgaacgattccagtttgtggcctcttcgacttcagcataccccaagcgtcgtctgtgcaccgtttgtggctacaaggggttttgttcctgcgtgagatgtggattcagatactgttccaaaacctgtgaagaggcccacacggagacccgatgtctgaagatgtatgcttagatgagaacgacgacttgtcattgatacagcggcaagagatgactgtcagcaggacagggctgatttattctactaccagagaccatggtttcgcctagcacgataaactgtgactttacaactcatgctagttaccatcctataaattccggttacgcgctatctacaggaatgtttctgaggtcagaaactccttgtagttccagttctctgctttcttgtcacacccaaccaccgccgacacgaacggtatgtacattaactatttattaatactatccatttatggtcactctccctgaacctttatagtacccgactcctccagtccttcctgtcctttcaactctttcattttcaccaacatagacgccttccagttgtgatagtcgtttctcttcctgtaactattgaatgcaaaactggcgggaatcatgtttccaatacctgaaaacgacgacttggacgtctgtcgatcaagctggcgttgaatgactcccggagcaatgccactcttctgctccagaatcttgacccacatctggtccttgagaatagtctcagtccaccctatccactcctcaactcggtcttcgggcatgcctgctcgtcgtgtaagctgcagagccctctgtttgaacgcctcgcgcgtggcttctgtatcggtaaaagatctatgctgaatgtggaatgcaatggtcatcagcagtccgaacagaagcccccatctgtccttgactagggcccagtaaaagtcgaatccccgctggacgccctccaatgcatgtttagggaatcgcagctcctttgtaatgaattcaatgtcggctggctgtggatcgtcttgcttgggccctccttttctgggcgatttctgcggcgactttttcgtctttgaaggtgtatctggcaacagcccgtcttcctctccaatcgcctcggaattcaacagatcctccccgatcacattggcgtcacttcgaccgctctcctggatgtccttctgcacctgtcgagcagtccttggtgttttcggcgttctctgagcaaccaattcggggttcttcattggcgactttctcttccgcggcgtcgaggggccaggaggagcgcccagaagctcctctcggaacagttggagaagcttctcgtaagatctcggtggaacgggcggttgtgattgcttgggtgccggcagttgcagctcaatcagcagcttctcaatcgctacatgggcacacagagccatgcgagcaggagtctcgttgggcttcattggaattgtctgagccttgcccatgagcgtggatgcgagatttgtcacctcccttggaatcggaacgtttcccaccagcttgacaatctccgcgttgatttgttggttcatggtgagtgtactgttgcgtcacatccaacttttcagattgtcccgttcttgtattaaactattagagtttgggtggataacactgatcaggatatgataaaagttcgtatgtaggagccaagtaggagtgatagggacatgccctacggtatgtagataactcatagttttgtctcacttgtaactatatacaggtagtcaatttccgtatcatcctcctcagcatgtccaccattatctattattatatgtaaagattgttccaccgttaattaaaccgtacctgttctctctcactctgggctctctgttttgttttgttttgagtcgcgttgttttgtttttatgaccattagcttgctggtcgtctcctaactgaaccacttcaagatgtaatagaaacacacgagcatgaagacgatgcctccgtagaaaaaccgtttgtcctgtcgtgctctcttctccaccatcttgatggtctctcgagacagacccagagtctcggccacagaccgcatcttctttccggtgcttctcaaaatgtcgctctgctcctgcaagtcgcccagagcagccattccctgctcaatgaatgagtcgagctgctggcccacctggttcagagacgactgttccctttgcatgccctcttctcgtgtaagatctgtgtaggtcggctgaatcggcacgtctcggttcacgtttctgtttcgcgactcgccgtaagggttgtctccaaacagcgccgttttgttctcctctagcgttttctcttctcgggccgatctgaggttcttgaactcgcttcgtgcgtcggccagctcttcacgaaaccgagccagacgtgcctcagccttttccttcttctccttgttgtgttccttgttgataatttccgaatagtcgtccagggttcggctgaaggaggtcatggtagccgaaatctggccttgtagcgacatgggcgcccctgcggggttggcggagaactcggacaggtccttctttaagctggcattctgcttcaccagatggttgtgaatcgcgttcatggtgaaagtagctagtttgcggtacgagccctcgttgtttgttagatgacgtgttaggttggtgatgtatctccaaggtgtgagtagttccaacaacctaaacttttattgttgtggttggcacaatgtgatgtgcacgggatgcactgctttcggagtcaggggtacaaaaatggatttatggaaagtatggcgaggtttttggagctgaactacaagtagaggtttagatagcgcaagaattttttcaaggggccgttaataggacaacgtgctttttttttctttttcccctgcatacaagtaccaggtggagctgagtccaagtaaacatctactaaactttgaactagctgctcgttcttaacaagcttcaggctgtaaattgtacaaatgcagaagaaaaaaaaagttggctacgagggcatcacaactcatcaataatagatagctatgcagctatacaagcaggttcgtacccgctcataagcaagcccgcaagcttgctcactctccccttcttccgtgaagactctattagctatgtacaaataattctcccttaagtaacgtactttcgagagtaagcgaccttcttgtcgagagtgctcattcggccctttcgccacataatgacaagcatgacggtggtaaacacacacacgccgtaccaggtggcaatatactgtaaatgggtgtttcgaagatcgaccttgggcagctttccaatgggcactccatggttcatcatatgggactcggtgacccactcgtggcctccgaggcgcatgttgagctcctcctccaagtaaatgttctgagctccggtgaacttggacattgtcggaatgtccatgaagttgtagattcggacactgggggaagttggggaatcgggagtgaacatgttcttgagaggaacaggtctgagcagacagacgagagaaacctcgcccttgggcagagcgagagggtctcgtttcttttggtccgccatctccttggaaatccagcctcgcttaatcagcagcttggatccaccggtcttagatcggtcgagaggagtcacaaggaagtagccctcgacagagtccttcattcgaggtccgaccaggaactcttcatcgtggcacagtgtaccagtaaccaccacctttcggtactcaaactctctctccagaacctcctggtcctcggtaatgtgtccaggcaggggcagaggctcctggagaagtcggttctcacaatcggcaatcttgtccaccttccactgcagacgtttgacttgccatgtgccaaggtagcccgaaatgataggcatgagggcacaaagaccgaggaagacaaaacgctttcggttcttcttctgtgattgcggctctggctcgtcgctctccagctcgttagctccagactgcttcttctgctgcttaggttcttcactgttggtgttgaacatgtttttgttgttaagcagagcgcttctggtcgaaaactgtcgagaggcacattgaggggtcagtgtagtgaaggcaggagctgtggtggaaatccttccaatgcggctagcgccatatcgagccactctgagaacttgcattgttgatgaggaaaagtggctaagtttcgatatagaattgagtatctgcacgttgtgctgactaagtgtggctagtttgggagattgtggcgcagtagccaatcggcgaacatgatgcggaacatgtttgagcgcactaaaccacattaaaagtactgagacagatactataagattcatggaattatcccttgtactgtacgtatacttgcacctgctatattcgccacagattaggacggaattggagtttttagtatgtggtctacgattgtgctgtttgtccacttcacaactaccctctgtgctgagtagcatatgtcatggtggcatcttccggctgtgtttgtctctgttacataacactgtctggctttcgaagctcgaagagttggccaatccctaatggtgtgggcgctcggagcttctgctacttgtagcatactgtagctcactgtggtcctaactgcatctactatgaccctctacattccattactgtataccaaatgcaaataaataattatttatgtaaccacctaactatccctggaataaggcaggataggtattatgtaaccagttgagatactgctgctcaagctgaggagtgtacttttgcttagcctccagcagttcaatctcgttagtccgaggacccagtgtcttggtccatcgacccttcacactgctggagtcgtgatgagtgtacttctctgcaaacggctcatatgagctataagatccacgttttgaggggtccaagtcacagacaaaggccttgatcgccaggtcgtccagatctgtgtacggaattcgcacccgaggcttgggtcccgtcgttcgttgagccttgtgcatgatcttggcaaagacatcactcacagaagcgccttcaatgacaggagcattgagggctatatcacgtaaattctcgtcggcttccagcttcgagagacgagtttgcagggagaattctgtgtgtccaatcatcgcggtgagctggtcaaagagctccttgcgaggaatagccagtttcttggctgtttctgaagtttccaggagcagtctatccttggaagggttgaacttgtcccgtggtcttcccttcttccctccctggagagaatgcttgccgcggcgtctcggctgtatcggcagaaactcgtcatcgaactcgccacgagttgaatgctcgttctcctcgtcgtctccatgatcgtatgcgtattctccttcatcttctttgacagcgacttgatcccggctgttgttttgatgttcattttggtgtccattcccctttctgtcctgcccgtattcatcatcactgtagtggtcagagtcgctctggacaaagaactctgcctgtcgctctcgggaaaactcggtttcgaacccgtcatcaaatccgtcgtcttcatccagcaacactcggcgtcgtctacgagcttcgctgggttgtttggtgggtgacttcggtggctgagaggccctcgttgatagtttgggcgcctcggctggagtcttggagagagatctgcttgatcttgtttttgtaggagtcgcttctcggtcggattctgactcggaaccatctacaggttcgtcctctgtttcccctttattgccgagatgatctggggcggtctcaaactgttcctcatccttttcaaactgctcctcagcttcgtagaacttgtcattctcgtgcctcttgggttctggtttcacagactcctggctttcttgagtgtgtgatccaaaatcatcatcagagtctgaaatctcctcgacctttcggatccttttgttgcgataggttcggattgaaggttgagtaatagacactctcttgcgaggagacttcttgagagaaggcagtatcgattccgaaactgagtcaggaatcgattcttcttctctctgtccttcctgttcagattcctccgactcgtttgtggtgttggagttgtcagaaccgtcaggaccgtcagagtccgagtcctggcccgatccctttccctctcccgagtccgagcccgagttgtcagagctgtcggactcatcaatctgggaagctgtgacgtcagtcacctcttttttcacgttcactgttttaccttggggttccgactcttgttcttcctctgactcctcagagtcactctgatcgttctgttcgtcctcgggctccgtgaccttagattccttgttcacaggttggaatgggttatcgtctccaccttcctcgtcatccttatcaacggctaacgtatcgtccaccgtctcaacacgtattcccttactccttctcctctgttgtctgaccatggccttgaaccgtgatgcactgctctgatacttcgccgatgcgaacttagagggagtctccagaatagcagcacgcgccagcgaaggtgtgcttcgcagcttattgagaatggtgcggtcatgaaactccaacgtagggtacatttgcttgtgatgggccatctcgcgcttggcacagatgttgatggtgtctcgagacggggcgagcacctcgactccgggaatagctgcgatcaccgcctcgcggtttttggttcctggagaaacgtaaaactcgtgctcttgttgtaaatgcggtcgcggcgtcatgtgtcggagcagccggcgtatatccaaggtcgactgtagtacgatcactggtacgggtaccgtaattggagatgttgttgtggtgtatcgcttctaaacagagttcgagagctagtctaatggcacgctttgactaaacattctacagtaagtgcaagtagctacagtagatactacaatatcaagctaacttgtagtaattgagccggtgctgtcgttttcgtgtcatgaaattaggcacggtcaaaacccattgccatggaaacagtggcgagacacagcacagtttggactatggaaaacagttcagacgcagctgctcaattagctattgcttgactatagactgactgacactccggaagcagataaattcctacagcatagtcccacggctctccttgcccgtacagacacccatgcctattatacaatgcacgtcacaatgtagacttgggtggcgtcgtagatgcacaacaatggagacggagcgtgtcgagcagtgtcaatcgcgtgtacgaagcgcgttatagagagggtgtcggatggttgccactacaagtatagtggatacactacaagtacccaaagatgggttggctggtcatctcatcgaagattgcggtcctggctaacaatagctgatctgcaaatgtcttgtggccataactgagaacacaatggtctcgtacctaaccgttttatggtccaaggctgtacaagctggtgtggacaatggagcaccatatagaaattatagcggcaaagaaggtgtccgtgccatagaaacaagcgtaccaacggccacagcagcgacacaatcaacagcagcagccgacaacaaggactacttgtaggttgatagtcggcttccgcagcgataagttatttagaccgaattaggcattgttatggaatgtgtgggtcgcagacaatggagctgcacgttggcttcacttccttttggatgtgcacagctccaaattgttgttgctgcacgcttttttcgtgcagaataatatagggttccccgatttggatgctaaatgacgatgcgcgtcacttttagcgcgcgttgaagggagaacgatacagcatgtgcgtgtaggacgagagacggataatataaaagagatattgcttagctattgttttaattgaattttctgtcattttcttatagtagtcatataattttttcttggaaaaccactgatttgcacaaactaacgcgtgatcaaaacacgaaaagagctgtaaatgaaaatcatttataattgagttcgacgcggtggcaaccgtgaccaacaggatccaaacaccagtataggaggtgataaagaggagctgttgataaggagaaaaacggatatgatacgaatgattttttgcaacgtctactgatatgtcatttcccatctttgcttttctttcacccctttatcacgacccatttcagtaacctgcaccttgaccctaaaccaagggagggaacctaattccgtcaaatatataagatacgtgtctccctgtgcaagcgtgttttcctctctccttttgcatacccatcccccatcatgtccaagctctttgtcatcaagcgagacggccgcaaggagtcggtccaggtcgacaaaatcactgcacgtatcaagcgtctgtgttacggcctcgaccctgaccacgtcgaccctatccagatcaccctcaagattgcatccggtatctacgagggtgttagcactatcgagctcgacaacctggctgccgagacagccgcctacatgaccactctgcatcctgactatgcgattctggctgcccgaatcgctgtgtccaacctgcataagcagaccaagaagcagttctcgcaggtggtttacgacttgtaccactacgtgaacccccgaaacaagaagcactcgcccatggtctccaaggagctgtacgacaccgtgcaggccaacgccgacgagctcaacggcgccattctctacgaccgagacttcacctacaactactttggcttcaagaccctggagcgagcatacctgctgcgagtcaacggtgctgttgccgagcgaccccaacagatgatcatgcgagtctctgtcggtatccacggcgacaacattgcccgggccattgagacctacaactatatgtctcagaagtacttcactcacgcttcccccactctctacaacgccggaactccccagcctcagatgtcgtcgtgtttccttgtcaacatgaaggacgactccatcgacggcatctacgataccctcaaaacctgtgctctgatttccaagtctgccggcggtatcggtctgtctatccacaacatccgagctactggctcctacattgctggaactaacggaacctccaacggtatcgtgcccatgctgcgtgtctataacaacaccgcccgatacgttgatcagggaggcaacaagcgacctggtgcctttgcaatgtaccttgagccctggcacgacgatatcttcgagttctgcgagctgcgaaagaaccacggaaaggaagagattcgagcccgagacctgttcctggctctgtggatccccgacctgttcatggagcgagtcgagcagaacgctgaatggaccctgatgtgccccaacgagtgccccggtcttgacgacgtctatggtgatgagtttaagcagctgtacgagcagtacgagaaggagggccgaggccgacgaaccatccctgcccagaagctgtggtaccacattctcgactgccagaccgagtccggcaaccccttcatgctgtacaaggactcctgcaaccgaaagtccaaccagaagaacctcggaacaattaagtcttctaacctgtgctgtgagattgtagagtactcttctcctgatgaggtcgctgtctgcaacctggcttccatcgctctgcccacttttgttactcgagacgacaccaactcgttctacgacttcaagaagctgcacgacattgccaaggtcattgtgcgaaacctcaacgctatcatcgaccgaaactactacccggtccccgaggccaagaagtctaacatgcgacaccgacccattgctctgggtgtccagggtctggccgacaccttcatggctctacgactcccatttgagtccgaggaggccaagaagctcaacatccagatcttcgagaccatctaccacggagctgtcgaagcctcttacgagatggctcttgaggacggtgcctacgagaccttccagggctcccctgcctccaagggtgacctccagttcgatctctggaacgtgactccttccgagctgtgggagtgggacgatctcaaggccaagatcatgaagactggtatgcgaaactcgctgttggtcgctcccatgcccactgcctccacttcccagattcttggtttcaatgagtgcttcgagccctacacttccaacatttactctcgacgagttcttgctggtgaattccagattgtcaacccctggctgctcaaggacctggttgaggttggcctgtggaacgagaccatgaagaaccgaattgttgctgacaacggatccgtgcagaacatccccaacattccccaggaaatcaaggacctgtacaagaccgtgtgggagatttctcagaagcgaatcattgagatggccgctgaccgatcccccttcattgaccagtctcagtccctcaacattcacatcaaggaccctaccatgggcaagctcacctccatgcacttctacggctggaagaagggtctcaagacaggtatgtactacctgcgaaccatggctgctgctgcccccatccagttcaccattgaccaggaggctctcaagaccattgactccagcaccgccaaggccatgctcaacaagaagccctaccaggagatcaactccatggccaacttgcggtccatcgaggacaagattgccaagattgatctgaatggaggcaacaaggagaacaacgtcatggagctgatccgagagtcccaggaaaagaaggaggctgagaaggaggccaagcgagtccctgctcccgtggctgagaccaaggaggagacccaggaggagaccaagcccgttgaaaagcctgctgctgctgaagacaagcctgccgaggactcccccatcgccaagtctgagtacgacatctatgcagacaaggttctggcctgctctctggccaaccccgagtcttgtgagatgtgctctggttaacttttgttatgttatatatataacttgctatttaatgataatgataatgataatttgtgacaggtaaaaaaacagtaaaagctacaagtacgatagatagtggagctggctttttaagtacagtacaagtcggaggagaaggagaggttcgaatggtacagtacatactcaccttttgtttgggatattggaaccatcttaaacttaactaactgcttgaatatctcaactattttatatttcataaatgtcaccaatacagcttctacagatcttaatccaagacgagaaatattcattagaggtccaactgacacttaatcggttaattcaccattatattgctgataaataatttttttcgcagaattttcgaagtttttcaaattataaacctctattcctgactgcttcaatgtaagagatcaaatcgactcataaggtgtgctaggattagtcatcgagtgatctcttactagagaaagagtgagacgtcctttaggacgtctggaggatgtcacgtgcctcgcacgtgaccttgaggggttacccggatgttaagggttaccctgtgatgcagggggactgtataagtaggatattacgttgtattttaatgaatcaagtttattgccaacaacttccggagtacaagtggtactccgtagcagaccagcggtccccgctttttttttttttttattctaatgattcattacagctatatacctagtaagccgggttattggcgttcaataaaacatacacttctgaatctttgcgatgtgcgctgcggggcgctgtcggttggtttgtcgacgcttcgtctagttgatgtcattgtcgtggtctcgtggtagtgaatcatggctaacagatcaagaaatcatatcaatcgtttcatgtcttatccagactcgaggttggtttagtttgttctcataatagatcgtagacggtgtaattcggatagggatcatgaatatgattcgtatgtgtcgtgtttgagtcttcgcgccatcggggagttgaagctcggtgtttggttgtttttttttttttgttttttttttttgtttttttttgtttttttcataattccattaatctgagacgtcagcgtgtatatttagcgtgagcagacctcacgagtacgtcatgtgtaccagccatcgtaataatgctcctagagtagaaaacaacttcggcactcattcctctccgcgcttccgcctcatagccacgatcaccatgtcgcgacgatatgctgcagaagctcgggtgaacaagtgagcgaagtctcgctggaccacggggtcagtacccactaggccagtttttcgcatagctcgctcgaactgccacaaagcatgggcgagctctctaatgtagttcagcgggccgtccttggcttccagtaagatccagtccgccatctttgatggaagggggacaccaatcttctggcagatggccttggacgctggacaattgacaaaaaggtgctcatggaggtagttcttctgtttgaagagttgacaagaactacatccaaggtctctgtactggacagatcttgatctagggtaccaccgggtgaaggggaggcggttcagccgcaacatgtgtagcgtagcagcgctcttatcatcacgtcggtagtgcttgctcaggaactgatttgtcttaagccagtgtaggtggttcggatcaagctcggatggcagtgtctccaaccagtgcttgttcttcatgaccttgaaacgatctcgccagctatcctttgccaccttgacagggacatcgatttgcgactcgagatatgcaacttgctcccgagacatggttgcgatcgggttttcacggcgttggcattcgaacaggtcaactttcgtcctctccgctggtctgagctgaacgactgactaaactggatctggtttctgacaattcaaaaaaacgggcaacctggccgagcggtctaaggcgccaggttaaggctaacaccttaacgaatatcctggtctcttcggaggcgagagttcgaatctctcggttgtcattttttcattgtagttcaatcactcgaattttccttcattttcgagggtatgtttttgctgctcatcttctgcatatttcgttgttccaattttgaattgatgcgtctcccaatgagcttaaattcacatgaaaaatagaagtgtctctattgaagatcagaagtattattgatgtgatatagttaattaacaacttacaacccctttctagggacccgacgttccgatagtagcacacaccagaagggtgtgtgcttgctcattcaccagaaaagagattctagatcagtggataaaatctacaggatggacatcttgtctacgacccagctgattcctctcatcactatgtggtgacatctcatcattatgtgaggaattagccaggtattaccccaccgggtattacctttaacagtctctaccagcaaaaaatagttggcacagagaagtaaaaaagaatggacgacaccggtgtcaaactggtgatctcgtgcatgctagcccatgtgattactaactacttgttcattttctttttcatttcaagtatataccacatctacagtaatacattgagtgtgttgatatcgcatattcatgaccatgttaaatatattcaaaactacctgcgcaagtacatgcactcttttttacaactcctctccgcccttgcttcggttaacaagcgagtagaaaaaggagtcctcgttcttgagcagattctcgggtgtatcaaactcaacgacctttccagcatccagaaccatgatgcggtcactatccatgacagtgttgagtcgatgggcaatcgtgagaatggttctatccttgaactcacgtcggatcgtttcctggatcaacttgtcggtctcgtagtctactgcagcagtagcctcatccaggacaagaatgggcgaggggttgagaagagctcggccgaggcacataagttgtttctgacccagcgacaggttgctacctccgtcgttcagcttggtatccagtccatcatgctcgtccacatactttttgagagacgagtgctccaggacctccagcagctgctcgtcggtgaacttgcccgcaggatccaggttgcccttaatggttccctcgaacatttgggcatcctggggaataatagagagacgggatcggagatcctcaagaccaagcttggaaatgtcttctccatcgatgataatagctccgtctgtggcctcgatgatccggaacagcgccattgtgagagacgactttccagcaccggttcggccgacaacgccaatcttttctcgcgggttgatggtgaaggaaatctctttgagcacaggatcgagattggcccggtacttggtggagtagtcggagaaggtgatcttaccttcgttgggccaatgggcagcaggctccttggccttgagaggagcctcgggctcgatgttgcagtactcgttgatacgctcaagcacaactgactcctgttccacggtgatggcagttcgaaccacttcactgagactctgagagatggtagaggcgtaactcattgccagaccaacgaggccggcagaaagagctttccagtgcagagtgccgacaagagacaggccagaggcgagaaagattgcaacaccgatggcacttagacgcaatgagagccactgctgaagagaggccatcaggaatcgtgccttggttctagcgtcgattctagcagtactcttggtagcaaagtacctgggcttgccaaaggctcgaacggtagtcagaccggtgagagtctcctggaaatgagaaatgacaggagacatcgcggcagcagacaaccgtcgagcttcccgagaagtagccaggtagtactgctggatgattctgtagagatatagagcggggacgataacaagaagagtggagggagaggtgagtacaatgacacacagtgtgctgaacgattgaatgagagaatttgagaacgacacaatgatccaggtcatcatccagtcaatcttgccgatatcctgagagaatcgtgaagtcagacgtcccagaggagttgattcaaagaaggacataggggctcgaataacagccttcagcatcttctcgtggagaactctagaagctctgagagatccaaaggtgtcccaagaaatagaaccaagcacatcaaatagagctgcaagaacgccaatagctaagtatccaagcacaagttgcatatcgttcagatcaatcttgtcgctgccccacatggccacccagtatgtactgataatagccattccagagccaaacatggtgaaggacacgtagaggataatgttgtgccatccggcagcagaaaagtagcccttgtaaagctggacgatgtttgcggccccactggtgttgacctcgccctccacacgagttcgtcggttgtcgttagcaccaagcgtgagaatcgagaagtgggaaacggaggaagctcttcggagtgtagaaaaagattgcttcttgagctgctgctcagcagaaagatcttcaatagaagagcctacctcggtgtcctctccatctgcttcctcgttaattccttctgtcttcttatcaccggcagcggtctggaattcgtcaaccagcttcttcactttgccgttctcctgagacatgagttcagcaaactctccagactcaacaaaggtcttgtcctcaatcagatgaatggtagaggcgtgtcgcaacagattgacggtgttggtcgccataatgactgtcttggtcttgagcaaaccgtcaggtccaaacacatgcttaatcagatgggcctggacatgttcatcgacagcagagagggggtcgtcgaagaggagaacactggcacgagaatacacagctcgagcaatcgcaatacgggccttctggccacccgacaaagaaatacccttctcgccaacctcagtcatatctccatcagcaagaagctccatgtctcgagtaagagcacatgcttcaatgacaagattgtagaacacggggtcctctcgagatccaaatagaatgttgtctttgacggtcgcatttagaatccagggcacttgagagaagtaagcaacggaaccagtcgtccaagaagagccctccttggtaaacagttcaccgagagtagccatcagagtagctgtctttccagcgccaacctttccaatgatgcataccatgttacccttcttggcactgtaagtaatgttctccagagcgacattctcaaacttggagtcccagcagaaagttccgtggacgttcacgggagtctcggcagaagaatcgtcagcatgggcctcagtatcctcttgaacgttgaatttttcgacctcagtgagacccagaaaccggttgatcttatctagggcaatccatgcctgaatgatgaattggataatgtagggaatgttaatgaagggctccagaagtcgtccaaacaggttgagagcaggaatggcactggcagcagaaaggggaaggtgctggaacaggacaataaaggcaaaagctgcggtagacgaaaagtaggtggaactattgaagaggaagttctcgacagcagtgaggtaggtcatataaagcaccactccaagctcgtcctcatttcggaccttttcaactttcttgaaaaaggtactctcccatccgtacagcttgacagatttcatgttagacaggagctcgttggttaaagtatatcgagactcactgaccttttgtaacttgaggtacagagtcatcttcatcttggagatgagggcggttatgggcaccacaaccaacatggcagccatacccacccacatggcgtttccaatcatactgtacatggtagtccaacagatgacaatctgcagaggcagagaccagactgtgtgaatgtaatcaagacagtttgacaacgaagtgacgttgttggagagaatattgacaagctcaccgatagaagtctcagccacagcagaaggagccagtttgagggccttctcgtgaacagcctgactaagggaagtctggaaccgcaacttgaggttcagagtcatgagcgactttctgttatcgagtacggatcgcataatcatcactgtagcggcaacaatgacgatagacagaccctgggaaagcggagccttgttttcattgtatcttccgacaaagaggatgagctgcttcaaaagcagaggctgcacaaagggagcggcagtgcagaagacctgtagacaggttattttcagatagtccagcccgtaaatgctggccagagtcaggagcacagaagggaacttctccgtcttcttctccttgtacgcctggatcttatcgtcccagatctggctgaattcatcgtaaatgttctctgtgagcagctctctgggaggtttggggatgtgtcctagcttaagagtctccttgttgcccaggtcgagaatgggagccacatagctgtatgtgagcttggataggaagttggaatcgtcgtagtaagctggttcggaggagggagtgtatctggcctccagaatgaaactgaagaggccgaggaagccgagagataccacagcaaaaatgtaaggtgatcccacaaatcctcgcacaaagaatccataaatggctatagaagcctcgatgatctcgaggccccagaaggtcagaacggctgtgctggcaacctggcgtttctcaaactcgagcttttggattaacagcacgatagtggtacccacagcgaggattagaggtgaccagaaccgcaggtcgttgtggccaaactgctgaagcagcggaatggcgagcgcaaccgcaatctgcagaatggtgatgatctgtgttagtacgaaattagtagtgaagtaccaagggttgtattgcgatactcacctgcttgagattgtaatcccatagggctggtcgtttgcctggaagtttcgataagttatagagaccgggagctccgaacaaaatggcgatcgcaccaggtagaatgaaaagaccgttttgagacaaacagggcgagagatcgtagtaccgtgtgagcagttgccacccttcggggtctgtacaatacgacattgtacttgttgttgcttgtatctgtctggatgatgggactgctgggaagatttataaatatagtctctgcacacaactgactgccgtgctgcagcttcggtaaaattaaggtttcactaacacgacctgtgcgagaaacgaagggaggataaaccgcgtgtttcaggtgatggcggtgattttgagccacaaacgtatttagtaagattctccaaagtttttgattctttttgaatcgtcgtattccccctttaaacccatcttctatctcctcaaagtcgacaagtgttggccatcaaacctaatcatacatcaatgggtcttatcaccgacactgacgaatgattccgtgaaagctgcggatggatgataactgcggttatttgtgcgacaaaaaaagtatccacaaattacagactagtcgagaagcatatagaggagtttccggcgtctgtgcgttcaaattcctcctccttcggactccgatccacgttgaaaagagccactgaccgcgtcgtcgctttggtgagacaatcagccacactaaccgaaaatcggtgccgtgtgcctcttatcaataattataagtacagtaagtacactgtacatactgtaacgtcggcacttaaacccatacccaagagccattctagatatgcaagcgaggaccagacagcctgcaaatacgaatttgggtgcaatagcgtagcgtaacgacttgggtttattgttactactgtagaagcaagtggttggttaccattggagtgaagtcgtgtgaattccctatcaagctttcggtagttttgtcatcatgcacttctgaagtttagacagtgaggtggggaattatttgtattacaagtatttgtatggacagacgtgctgtttgtcccgagaatccattatatattgactatcagatcattttcagttgtgttcatgcttcatgtcaatcccatgtcattcctccaccaattgaatactcctttccagctcacactctgacaacggcgcaggtacagctcacataatattaaagcggctcttctgaaacatgcccgttctgggatgacctccacagcgtgccgtcgtattgtacaatgtatgtactgtagaacatataacatcggcagtgttcaaaccaagccatgatttaatccgcctaaggtgacaatccacaataagacgcttggacgtatcgatttttactggctaatcattcgctagcacacctcaatttgtacaggccagtctaccgttaatgctgacttagtaatgatgatataagcagtgacaaactatggtactgtactgtacagtacagcacgatgtacagtacgagtgcttgtagtagttaaaccaacttgatagttttcatttacagggcatattcgtgggaacctctgagggttgatatcaggttatcttttaccaatgctggtcttgcaaacagtatgtacagtaacctcaccgtgtacattctggagcagtgtatactgtagttctgcccgacgagtacagaaggcaccggtgctggtagccagttatagtcacatgagcttcgggtaatattcactaaaatctcttcaaacgatcctcaacagcttgcgtgcccccttctggaaggtgtgttccatcgttgtccatttactggtagcatatgtgcaccctctttccatactgttgtacgtacatactgtagtgtacaactgcgagtaaacatactcatatctttttctcacgggacgggttgtggcttatccatagcaacgtcgaggctcgatggttacaataccaccagcagtccgcggtaacgaggtgtctagacagatgaaagaggtatacatgaacgctgaagtacacacattgtaataactctatgtgtgtgtagatctgtttatatggcctcaaattccagccagcttcactctccatattccctccttcctctctaattttgccttgggcacatgcattgaaggaccagacttgatatgagactgtgagacttgaaaggtctaaatttttcctacagccgatacagttgcacttgcacttgccaaagtcaatctatgttcaatcgttggcgagggtagctaccggcaaactgcttatcgcatcactcagtcatctcagtatgtacagagtacggtatgtactgtggttgctgtaccagtacattgtctcaccccatcgattgaccacatgtccaccccacagaccatgtgctccacaaattagatcccaaactacatgtccgtgtaacagttgtggtgatcgtaaaaccgccactgagggggcggggaatgccagtggtgtcctcttttgtactctaatgtgacgcgttgagaagattacttgattagtaggttcgatccattgtgtgtcttacaaaagatacgatttcatcgcagatcgtttatgatacagcctgatgaagtggtcacatgaaatcaaatacccccatgacaccaattgaacatacatgatatcaactcagatacttcctcagacaaatataaggacttccagatgattattgacggtggcaaacagaacaaagcggtggccgttgattgtccgaacaaaggagtttggcatatgcttaaatcctcaacaacattaatgatccgcagagttcggctgcggccaacggctgaataatggatgacagcggaatgagatattggtgatgaaatgagacaaaaagcaatcaagccaattaccttaggtctatttacagctactggtactggctaccacgtactcttaatacacaattctacatgtacgttcatattgttctccttttgttcaatgctaatcaataatgcttaataaatgcgaatgtcgccggcgacatgtgtgtgtgtttgtgtgtgtgtttgtcggtgtctgtgtctggttcggtgcgtctgatgtctgtgcttgggtttcatcaccacgagtgtctcatgaaggcgtcgtcataggtgacttctccagagggccactctcctcggaactttcgaacctgaaagtactgagagggaacgcccatcagcgacaggtctcgacggggaacgaattcaaactgcttgtagaactccgggtttcccagcaacacgacgccaccggcatcgagctggccctggcaatgctcaatggccgtatgcatgagtttggcgccgatcccgttgccctggaagtcgggcaatacagcaatgggtccaatgccgtaccacttggggctctgaacctgtccgtccaccttgacctcactcaggaaaatcgtgccaaccacctgctgtgtattgttatcgatggcgacccaggacgctgtgagtgcgcccgtggctcgcaagtcgtgcacaatctcctgctcctggtggttggagatggcgagcttcgcaaacgcagacttgatcacgttggagatatcatccttgtgccatggcagctcaggtgagatcttgacgtccactgtcgacgttgttgtagtgctccaagagaagatcattgtgtgtttgtgtgtgggtatgcgagtgagatgtacgtgtgtgtgtgtctgtgtgtaatgagatgcaagttgtgtttgtggtggtggttgtagaagttgtctgttagttgttggtccttcggtctgtcagtatcactatggggtggtggtgtcctgtcgtcgtttcggtccttgaagatatataagttctcttaagtccacaagctgcgccgtacatgtatataaatcaagtctcgggcggagcttctttcctgcttccctctatccgatttgagttaggccctggtaggattttggtttcaaagctaaaaattatagcgacgtaccagactctaaagttgtctgttgtcacaatcaaggtcaagacggggcaaaaggtgtattttagctgacgcccctacaagtagtctctctttggtccgctacttgtggatcacaacctccaaactccgaataattaagctccgtagctcatgtcaatatcaagtgttttcttcttctccggaacagcatccggttttcccctacattccggatcctgcacgtccaccccagatttttattttttattttcccatttccaatgttgcggtggctctttcggacgtcggcaactgtcagctgcagcacagatgaatgcccatctgttaatattcaactaaagttagttaggttttgtgggttgtagatttgtaagccctaaacccacttttgccttgagacataatttacgcacactgagtcgtcgcctggcgggaaaaaaaaccaaaacccaacactcaacagccacttttaagatactcaacagaaaatggcagaacaaacgaagaggtggcgtttctatacaccacaagcagaagaatctcatcggtctggagaggcaacgacaaggaataatcggacagtgtctcaataacccgggttgagcaatattctgaaacacaggccaggtctgtattgattatactcttaagcccttctaactccgacgatcacagtgtagcctagcgaaataagttttgggcacgggatacatctgggcgcgggaatactgcggcatttaaaaaatccggggtagccatagcaacaggctaccttatactcgaactggtgagaagagcaaatgaagaccctataagatctgagcgtgaattatacggttaaatctccgcctcactgcaacacactacagcagtttctgttgcttttgtttctgtttctgtctctgtctctgtctccgtaggcgattatctgttgctctgttgcagagctacgttgctcaggcgtagcaagaaagcagtcttggccgtcttaacaccctcctttttcatgttgagcagtagttgctgtagctgctatacatcacccactggcttgcgcttttcttgaatgttacatcaaccctacaagtagtgctctgatataggttccagcctcgcgtatgtgtatgtacagagcaaccgatagtccatgcgactgccgaattcggacacgggcatctcacttgcgtatgtatggaaaataaaaatacgacagtcgaacataaagggatgacgagtagtcacagagggaattgatgaacaaagacgggattttgccacctacaagccagattttctatttacaacaatatctggtcaaatttcagtttcgttacataaatcgttatgtcaaaggagtgtgggaggttaagagaattatcaccggcaaactatctgttaattgcctaaatgccaacaccgttgtaggcaacagcgttgggagagcccttgaggttggtggtgggaagaacaccggtgttggactcagtaataagagcctcgacctgggcaggggtgagaacctcgtcattgatggacaggtagtaggaggcaagaccggcaacgtggggacaggccatggaggtaccggagtagaccaaagtaccagagtcggactggtaagaggcagagatgatatcggagccgggggcaaagacatcaacacaagttccgtagttggatccctgtccaccggaccagacggagatcttatcgctagagtcaatggaacccacagtgatgataccagaggtggagcctccaatgttaccgggagagtcgttacaggcgtccacggcatcgtttcccgcagcgatggcgacaagcagaccctcctgggtagctcgagaccatagggcgtcctgggaagcggacttgggtcctcctccagagaagttcagcactcctcgaggcagagtgtctcgcttggagatgtagtcgttgagagcccaggtgaagccctggttgatgacggagagagctgcggatcggcctgcaaacaccttgacggccaccagcttggtgttggcgtcgactccgtatgtctttcctcccacggtacctgcaacgtgagtgccgtgaccgagaagatcagcgttctgtgtgtcagcgaagttggctccccagacagctcggcctccgaactcggagtgggtggttcggataccagagtcaacaacgtaagaaacggtggggtgcttgccaactgtctctcgaacgtaggcgtagtttccagtctgggccttcttatgagagattctagacaggccccattgagtgacgggagtagtctggatagctcgcttggcattagaagaagcaggaatctcggggagagacacaatggtatcgggctcgaccgtcagaacagacgactccttgagcttgtcaacgatagtggagttgaactttccaacaaatccgagaaagccagatccatccgtgtagacaggaagatcaagagcagaggtgataccgttggacgagtcctcgtcgaccagagagtccagcttctggatttcggaggcgatctggtcaacagtagcgctactgtcaaagacaacgatgaactgatccttctcatcaagatctcgcttgtggtgcttaaacttcttggactgcttagcgaccacggacagaatagatgagtaggcagcggcggcagggcccgtcgatggggtttatatcgtgtttctggacaagatactatccagaaactgctctgattgcgtcacgaaacacggctctcgccaagacgcgccaagacgatgccctcattatcttggtgcaatacaggtggagtgtgtgcattagttggtgccgtgccttctcacgatatctgacaggggcttgggtttgggttggaagtcggattccgctgaaacatggtgttgtgcagatgtgagtctctcaaagtcggttcatcatactccattgacatcatggtacagtgcgtacgtaaaagatggcctgactacaagtagtgggatctctctaacattgtccatcacatcgtaaatcacaccgcctatccatgaaccctgatgccgatcgtcgaagttagaccagggccagtggtgggtagcgtggggtaggctgccactgccgttggaaccccttgtgtccctggactacaacttaaccaacatgtcagacaaaggagagaaaagtgtccgctccaccgaactgacgccaggaatgtaccgtggcgctcaagaggtcatgtgtaattaaggatacaagataagctgcgcccttgaatgcaaaaagcacgcagctcatatgttaatttccaatcaatgtttcagggatgcataggaccccggatcgaggtgggcgggaacaacggtctcgataatgtacgtacactacacacaaagagaagcaagtgggggcgggactgcacggcacttgtgagacacctcagattgtacctgatacgcctgaatatcgcaaatattatgactgtgttgcaggcttgtcttgacactgtgttccgctagccggtggatgtaccatctatcaaacggctctacgtacgtaacccaaaacccaaactctccacgcgttgctgctctaactgtcgcgaccttatctctgacataatttctgtggcttggtacatacgccacgcaacgacatgttagctacaatagtctactgaaggtacagtactatacatacgcctgtttgggtggcctgtcaataaatcatgtgcaaggctacatacttctgctgtatggttggcttgtttagtgtcttcatgcatgcaaactgcattacctacccacccattacgccttcaggacgctcaccctcacgcacaacaatgactttccgagataacaattcccgcaggtcctctgtgatggaaacaggctcggagccgtccgctgagttgcgtctgtcctcgttctttcggtcaataagctcgaccgtacgtctgaatcggtagaacaagagctcggcacgaacaagaagctcgtccaaatcgatggtcatggacagctcgttcatgtacttcagaatctcatcaaacccagccagatggtcaatcatgacgtccttgtgcttatcgaggatagccaggcacacaaatagaacaaattgggacgacaggtaatctgtccacaacacctcccacagacgcaaaacgtcatcccagagcaactctcgcttgaaccacaccagcagcattctgaagaagaaaaacagattggttgactcggtcttctcaaggtgcttgtacagtgagggaagcataaattggaccaaatggtccagacaaagaagctggtttctcatgccactctggtcccggaggtagtttcgctccatgcgctccatgaaggccgaaaacgcccaaaatgccagtgtgtcatcctgcagcacgacatacagcggtgataggaggtctgacatgccctggacatagcccagattcttgttatgctggttgtaggtaatcaacatgtcacggagctggatcaaatgaatgttggagtttatctgggacgaaaacccaaactcatccttatcgtagttgtcatcatccccgtcctttttggcgtcacactcggcaaaaaatgtgatgtttcggtcggtacggtgcacgtctttttcgattcgggaaagttggtctcgccaaaagtcgtcccgctccttgtcctcctgtacccaccactccttcttgagccggttgtagtcaactctaagctttgacaccagttccttgcgttctgcagctgtcgagtcccaaggatagacgccaagcaggaacagccaaccctcgggcctgacagcgggagctaatccaccgtggaaaatgcgctccttgacctcattgactgtgacaatcagccgaccattgtaatcaaagaaggcgttccattcggccaacgacacttcgtttcgtctctgcgggttgttttcggcgtcaataagctcgaacccctcgtctgacaccagctcccgtagctcatcgtcaaacagaaccttgagctttgccctctgactctcctccgccacactgagggcccatttggccaagtagattcgagcagagtcaaaatcgtctccaattttcttgacttcgggcttcatgagcagttgcttgacgggctgtggcgaagagtcccagacaccctgagacacctttcgggtcagttgtgtcaccttagcaaggttgctgagaagaccccaccggatatctgagaaggccttttgaacctgggcccctcggtcaacagggtcacctccagcgcctcggcctggaataccagcaactagttgagaaggctcctcagagcctccggtgagattagtaccgaaccgttcagcgtcaccttctcgtgggttgacaagcaagaatgaatggtcgctttcagcccgctcgaggttcgcgtacttagagagcacttgaatgaagtgatcgccgccccagaacatagacgagcctgactcgctgtcaaaggtctcgaactttttgttgcgtcgcttctgctccatgattgtagactgactttcggcgtcgtggaagtagagcggaggaagctggtcttccttggaacgtgtgtggatggtgatagagccccaccaccagccaagtgagggctgtttgacctgtagagaaaagatgtcgctgatggggatagaaaacgcgtagctggagaaagaagaagagggaggtggcgacactagcgtctcggccaggttgagggacgacgaggccggggtgccactctctttgatatcgactttgacataagactcaaagtcggcggcggactcttgtagcttcgattcggggatccaagcaaccagaatttctttgtcggtggttgctccccgaggtttggcgagtgctagaaacccgggaatgttgtcctttgaggaaggtgtagggtgaacatagacctggtggttaatactggtaagttgtgtgtgtgacacagacacaggccataggctgttcattgttgtcaaagatgtcggtattggcttatttacaggtcaaccagacaccaaagtagcccttaaatcacagacccacggtctccgccgtctgtttgtgtaactcatgatatcaaacggctgtagcgccacccttcattgtcgtactcaccttgcttttgctaaacagcaactggcacttcgagctactcatgtgttcaacaatcacaaaactgtcgtgggaagttgaaggcgaaaaatcaaccgaattagcacgcttcatgaatggttgaagaggtcgctatcggttgcggtggcgctgcacgatacagagtttaaactctggggaggcgtgctatgatacgcgagatgacgttgcgtagtgggcaatgggagagtaggagcgggtgtttttgatccaaaaaaaaatgataataatgatgaaattgagtcacttgtgagaattatttaataaaattccaaaaatttacaccatacgacactgaaatgggccctacaagtagccatcactcacatggaaacggagatgaaacttacagtgtggtgtatcagagagagtggagagggttacaaaaatgatacaagtacaggtacagtatcagaaattttcatgctgtaaagttgataggtcgtcatttatcttgcaagtacttgttgcttaccaatatacatttggttgtcctttgcaccaactctctgtagcactgcctatggtgccaaaacaggcatctactgtacatacgttctgtatttgttcaagcggctaagcattgcccggatggtcactgtacatgatttactaattatacgtacagtatgtactgtaagtactgtaccagtacgatccacttcaccttcaactactagtcttgtagaaatgcactctatttacagaaaactacttgtactgtaccattagtctctgagagctaccctaagctcgtctacctctaccccagaaaaatgtatatgccgtcattcaccctttcagtctcaattcagacgcactccctgaacacccttgttagtaacgcttgcaatccaatctcccgatgcactccagcaaatgttattaacttcggccgagtccgtgaaggccgagtccagatggtagtcgcccggcacggccgtgttccacaagatgatctgtgagtcgtcagacgaagatgccaacaatctctttcgctgtcctcctacaaccacgctctgggggcaccattggatggcgttcacaggagcctggtgctgctgtagcacgtctatgggcatgcccggttggcgaatatccagaatgagcaccttactcgagttgcctgcaaaagtagccaaaatgttgccgtcgtaagggcatccggcaattcgcactagaggcggtggtttgggcgggtcgtatatgattgtagaatggtcgagggctcggagatcgaagactcggaccgatccgtcggccccaaccgatgcaaacacatctgtggaccccgctgtgaattgcacgtcgtagacctcttggtcgtgggcaatgagctgggtgcgtgcggacgatgtattgaggtcccacagcgtgcatgtcgtgtctatggatgaagtgatgatgagatgtggcgcgaccttgttccagtcgaacgaggtgataggcgaaatggacccggacttggagttggacagcgaacatcgctgctgcaaaaaccctttggacgagtcatacgaccagatgcgcagacagtcacctgatgtggcaaactggcgctttccctgagcatcaagccttgagtcccacgccagtttggtgcatggatatggcaccgatgcttctgccgccaagttgaacgaattgccttctgtgtgcaccacctggattttgttcttggactcatcgttgcacgtgcccaccgccaggcacgacatgccgtctgcagccggagtgctccagctaactgagtacagcggcatggtggactcgaaatatgcagatcttcgcggtagctggtagtcgctcggcgcgtacttcatccctgtagaaggagcgtaggagctagcctgggcagactgctcccacatgtatggttctcctggagccgccgacgcgctgtatctgctcgtcttggctgctgtatgaggtcccgacgaaccagctgtagcttcttcatcgtatggattccacccaggcgggtatcgctgctgctggggcgatatcggttgctgctgggcagttgaaaaatgcgagaatgacgaccgctttcctagagacggacgcatttccgggccctggtgtgtgatgatggatgcaatattggggtgaaggtggtgtataccgggtgcatttgttggtcgtgaactttatggggtagctagcgcacgactgaacattgttagctgccagtaccaatacgcacacgaacaccgagaggaggacattgtaggaacaagagtgctactgggaagagaaatataatttagagctctgagtagcagtataggagttgttattaaactggagatcttgctgaaggggtcatttcaggagtctgtcaccacgtcattgggcacgtgaccagaactagcggcggaagcacacacgccaagatacgaacttgatcatgattggtcatataagtactgtggctgtaattcctgcctctttctccgcacagaactggttttgagtctacaggtatccttatcacaagcctgacagtcatggtacggacttgtaccccgcccctcagcttacacgtgcatcaccaagcacacttggtagctgcaagataaagttgagctggacctgagtgaggatgcacaacctgtaaccaacacgacctcagatttgtgagaccacacacatcctaccctgcatccaatagacaacgaccatcatgtcataccaacgaagaatcatgaaggagctggaacggctaaaaaccgctcccccaaactgtgagtatcactacggacgttcacccactcttttgcgcctatcatactgtacttgtactaacccagcacacatcacactggttgaagccaatgacctggaaacatggcagatagatttggaggtgaacaatgacaacccgctgtacactggcaaaacgttccgactccaattcatcattggtcccaattatccggtggaaagcccccaggtgcaattcatgccactgccagctcgacccatccccatccaccctcacatctacagtaatggtcacatttgcctggacattttgggcgacgaatggacaccggtccagacggtggcgtcggtgtgcatttccctacagtccatgctaggaagtaacgacagagacgaacgacctccggatgacgaacgatacatcaagcatgcccccaagaaccccaaacagactcgtttcgtttatcatgatgacaccgtctaacctactaactaagaacatataaatgcgcaactatctcgtttcttgtacaaatacacttgttacacatccacgcacacctgttctaaatcatatattcatattcaataaatcaatgcaaaaaatgtaatgcaaatgtaatgcaataacatgtctgcccgttatttcagtattgtaggcagcatagtatcatgacgtgtatgcaaacttgtccttcaacgacgtggctccacccttggaaacccctctgttgacctttaaggactccctctcctgcttcagcagcttcagagctggagcaaacaccacaaacaactgcttgtggtccggaagaagagtcgcaaactcgctgtagctagtgggcaactcatacgacagcacctccagcacatcctcgctgcacacactggaaggccgggtgaggttctgctcgttgcagtgatcagaccgcacctcctctaatcgcttgtaggcctctccttggtgtctctgggtcaatgcggcctccgaaagtggcctgtcaaagaagctagaagtcgatttgttgtttgagatcggagtggttttggtagcggttgtggctgcactgccagcgggtttaggagcagcaggtttgctgctagtgctggaatcggatgtcaggttgatggtagctgtggtcttgaccctggaaggggttttggaagcagtagttctctggaggccagctccattgagggtccgagccaccggcttcttcgcagttgtgggagtgctcgtcttggtcactctgttttttatactggaagtggccgtggtggtcagaagagcagcacggcttcgagaagttggtttgggattgggttgagcgtacgctcctgagggagtgaggggatccagagagttggtccttctcgcaaacgaactggctgtttcgaaacccataggctcgccttcggggcgactgttcgtccgattgagaccaggcacggtctttttgctgccagtgtcatgaacatgagtgacaattgtcacctcctcgttgccctgtaacacgtctcgccacaaagagtccggtcggagatacgtacatgcgaatccggacttgtttctctctgtgtgtgccctcaacgccttcatcagaatcagtttggtgataattcgttccaacgtcgtcttgtcgtacaccttacctgtaccgtaccctgccaattcgttgtgacccagatccttaaccttcttcgttgctgaacctcgtatcaagtcaccgcagtaggccacagtgatgttttggttatcctgggtggcggcggaaaccaatttgatgatattcttagccacatcagtcacatctctggtctcccgagtgtattcatggccatactgacagttgtcacacgagtttcgacagagcttaggatcgaacgtttcgttgaagtaccgcagcacctgcactcgtcgacaatcaactctgttctcacagtagttaatgacaccctgcatcagctctcggtggtgagtacgctgacgttgggtcaacgcccagtctactttgccgttctcacccagaaactcatcgttggcaatgttgaacagcatttgccgggcatccttctggctgaagtacacaatgcatttggaaggaagcccgtctcgaccagctcggccagtctcctggtagtatccctccatgtttcgaggcacagtgcagtggatgacgtatcgcacatcagccttatcgatacccattccaaacgcaatggtagcacaaacaacctgaattttgccagattgccagttgccctgcacgtatgttcgctgctctgtctccattccagcatggtagaaatcagccttgattccagcttcctttaaaaactcagatgtggtctcacacagtttcttggagtggcaataaataatgcctgtttgtcctctgtagcggcctcgcagcatatctgtaatctcctgttgaaagttctttgtcttcaaccgcacctcgtagtagagattaggtcggttgaacgactgcttgaagaaccgcctgttaggtcgaagacagccctgaatgtccatacgtaccttttcgttggcagtagctgtcagagccattataggaacgccgggaagacgagacttcacatttactagagccttgtaatcgggacggaagtcgtgaccccaggaagaaacacaatgggcctcgtcaatgacgattcgagctagccgattctgctcatgcagcttatgaagtgtgttctgcatgatgttgctttgctgaaacatctcgggggaaacatagagcagtgcaatatcaccactggaaagggctgccaacgactgcttacgttcctgtacagattgtgacgaattgaacatggcacaagagatgttcttagcagtaagagcttcggtctggtccttcatgagcgaaataagaggcgaaatgaccacagaaagtccccgtgtcttgccaccgttcaccagggctggcaattggtagcagagagactttcctccgcctgtaggcatgagaacaagcacatcatcaccgttcaaagtggcattaattgcatgaagctggttagcgcggaattcattgagcatgaaccgttcgcgtaataccttgtaaacctcctgtgtccacgggtactcgtcttcctcgatcgcaacacactcttctgagccatcagagaggtccaggtcgtcgccaataccgatcccaatgtcgaggataccctgtgtggacgccccaacctcgcgtcggttgcccaccttgtccagggcctcgtcaaagtccatatcgtcgtcagccaagctgaatctggtaggagaagatgatggaaacaacgttctgccgggtccgaatgggttaagagcagaagagtcggggtctctatcttctctattgggactctggacttgaatcactgagaaatcagactcgaaatcgtcactatcgatctcaatgggttcggattcatgatgagatgcctctataggtttcctgggggtgacactaggaggcgccagaggcttctggaaattttcctgagcatcactgaacgacatgctatcgttacactcgtcgtcagagtcgtttttggccatatcaagctcgagttccaggtccagatcaatgtcgtccatgtcgaagtcggacagacttttcttctgttgcggttcctctttcttttccttacctgtttgtttttcgggtagctccaatatttcgtcgtcgggttccgagtcagagacaacttgtggagagtcggccctgctgtttgggcgtgctggcgtgtcaggtacctgggtaagagtatctctatcaaaggcagatgtgtcgggtttcagagctgcctccagctcgtcaatctgtgctagcagcagcacatcttgtggtcgatgccggagctttctatacagttgcagcaactccatcagttctgcatttgtagggatggctgatggtggtcgtaaagctttgggggttgcaagaacagacggcatagtgcatgggatggttgtggctgttgctgtgcgtagagccttccttgcaataggtgcgggaaggtcatcggatgagagattaaagtccgacagctccgagaactccgagaactcatcagggaaaggtttcgattgactgggcactgattttgccaccggtgctgcaatgttgggtctttgcgccgtagcgtgggtctctggcgatgtttccgaccctgcagatgacatcagtgtgaccgatctagcagccttctgtggccctgctatcgttggcctcatgtcgtttgtgtttgatgctgtcgcttgtttctgtggttgaggatgtgtctgtgtccgcatgggctgtgtggttgaccttgggccgacagatgtcgcgtctggcttgtttttcggtatgcctgtgatgctactctcagctccgtcccccacgccaccggatgactgtattcgtttggcggtcggagactttgggcgattggcagagatgcgtttcagaggtcgattgggagggggtttgggcacgttcccctcgttcttcagtagccactccttgtgtatgtcgaggttgtttttaaatcgcagtgtaccttgcacgaccaccatttgccttgactgtgagggtgtcagtggcttacagtaccttctatcgcgatatcagagtgtaggtttagggttgtacgcgacctttcgtgagctgctaaagtaaacaagttttggcttcaatgcatgtgagctgcactgagggtgtgtgtgagtgatctggtaccagacaatcgatagtaggagaacatggtgattaatgggtggaagggggatgcgggggttggcacagatgttgtgttatgttcgatgttgggttgttcatcagacttatccccttctgttatgttgatgtattataagtacaagtatatacagtaggcacgttaaatcggaaccatatagaggctgagacggcgcctcagagatacaagtactgccaaagcacataacaacagctgaccacacgatgctaggctcacaagtacatatactgtactgtaatgcacttgtacaagtagctagaacgacactgctgttcgacgtgcaacgcgatcataacctgtcggcttcatgaagagacacgaactcaaatatgcaccatgaaataacgcgtccccatgtacttgcccgtgtacgtgtcatgttgtggataaaaaagtaccattcacgactacagatcaccaggcaagacacaggaatgtgaaaaatgcctgatcacatatagttttctgtactatactgtgtgttccagacttcctcaccctcctacgagttcgagtacgactacgactggcacatcatgatactcgtacaattactgtagaaaacttcgactcagatcttcaacatcaggtttacacatattaacagagaggagtaccagtacttgtagaaaaggctacataacacacgtgcaggacggtaaaaagcacaagaccacacaagatgcgatggtctatactctgtccgacctctcgtacactttcaggcgtttccaaccaactatcttcaacctcgctccactctcactcactcctggtagagtttcggggctcccattcattgtaaattttctatcacgttgttataaggagtccttcggcgatgagtgatacgaacaaaccgaatgacataaatagagctgaacaaagaaccagacaagaatacttcattgttcccccaatcgcgtgaacggataattgtgtacatccatgcacgctgtccggctctactccgactcgctgtcattttcccccacattaactttagaaactttctggagcaaactgcaggacggatgtccggatcgcgctatggagctacagtagcagttacaggcaactagtgggtatacgtaatcacgagaaagcaggctcaatcgatccaattggggtacatagaagcaaccagcacttcttgacggtcacttcccaccaaaaatgttgccgtaaaccacccagttcttccgccaacaaccgctcacacatttaccatgtgattttggcaggcttaaactttgagtggggatcatgtaggccgtcaaggtgatcagtcaggcgtgcccgtgactgctgaaccagccgagccggagatttttctaggatgaatcacacatgactacaaatctcctgactcaattaggcggacaaacacaattttccgaactgcggttccccccaaactcgacaaagaaggaccgtgcctggagaaagccgagtcggaaaactctaaggaagtgtttgactccaagccctatttaacacgagcggttgctgattcggtcactaaaaaacaagtgcaaaaatgcttcgaacacgattcatcaacagcgtcaacagcgcacgagcaatgtctcgaaacatcaacaccctgtcgcaattcccttaccccacccttcagcaagaggagagcttcttcaagagccaggtcgaggacattgaaaagtggtgggcctctcctagatatgagggcatcaagcgaccctacaccgccgagaaggtggccatccaccgaggtactctcccccagacctacgcatcttccgtccaggccgagaagctcttcaacatcttcaccgagcgaggcaagcagggtcttcctgtccacacaaccggttctgtcgaccccgtccagatgacacagagcgcacctcatcaggaggtggtttacatttccggctgggcctgttcgtccctgttgactaccaccaacgaggtgtcacctgatttcggagactacccttacgacaccgttcccaaccaggttgatcgaatcttccgagcccagggtcttcacgacaagaaggcgtggcacgagtggatgtctctgtcccacgaggagcgagtcaagcgagaccaggagggcaagggccgaatcgattacctgcgacccatcattgccgacgctgacaccggccacggcggtctgtctgccgttatgaagctggccaagctttttgccgagcgaggcgctgctgccatccatctcgaggaccagctgcacggcggtaagaagtgcggtcaccttgctggcaaggtcattgtgcccaccggctctcacatttcccgactcaatgccacccgaatgcaatgggacatcatgggctgctccaacctggtgattgcccgaaccgattccgagtctgccaagctgctttcttctgctgccgatccctccgaccacgagtacatcctcggtgtcgtcaagcccatcaagcccctggccgaggtcctcctcaccgccgaggccaacggcgccactgccgatatggtcaacaagctcgagctcgagtggaccaaggaggccgagatgatgacctacgacgaggccgtgcagcgagccctgaccgaggccggcaagtccgacaagatcgaggagtacctgaccaaggccaagggcaagtccaactttgaggcccgacagattgccgacgagctggccggcaagcacattttcttcgactgggacgctcccaagacccgggagggccactaccatgtccagtgcggcattgagcctgccatcaagcgagctctggcctttgctccttacgccgatctcatctggctcgagaccaagacccccgaccttgcccaggcccaggcctttgccaagcgaatccgagagaagttccccggcaagtggctggtgtacaacctgtcaccttccttcaactggtctgcccatggctactccgacgagcagctgaagtcgtttgtgtgggacctggccaagtctggctttgtcatgcagctcatctctctggccggcctgcactccaacgccgtcgccacccatgagctctccacccgattcaagaccgagggaatgaaggcatacgtggaccttgtccagcgaaaggagaaggagcttggatgtgacgtcctgacccaccagaagtggtccggtgccaactacctggactccatcatctccactgtccagtccggatcttccggcacctcttccaccggtggcgactccaccgagaaccagttttaagcatggtacgatgtgtaactagctaactggatgaaagaacggcaaactgaacttccaaaggaagtgtttgtccatgtaattaacgatgacttattaaagaactgtgcgataattgtaacctagaatcgctcgtagtaatgtaataatgtggtatatcaatccataattatgtacagtacagtacagtacagtacccgtacttgtaccatgtatgtgctgtatatacgagtataatgtattacaagtacatactgtactcgtagtagtactacaaatcatttcttcagtaggaataaagcattgtcgccagcagtcagtcatcagcaaacatagccgacatagttgtgccgggtaggttaaatagactgattaataaatgattcaccacaacaacaaccaaagagccaaatactgtacaccatattgtacccacacatcgtgatcgtacgtgaaaatgcactcagaaacatgattagtaagctaactttatcacacgaccatggtgattgtggttaattggcgtgatatagtatttgggtcgaaaacaaagggaggacatacaactcaatttgatccgtttggtattctcctgagtctttatttttcgaatcaatttttttgatctttcatctccattggttacaggaactctctctcctctcactcttcagttccatgtcccaaactcctcgaatcaaataaagttgtctcaaaatttcacctcttgaaacctggtttcaacaacaatgattcgaagactggctcttggaagggtgagtatggaagggacaatgtggatccggcagaagaaacaagtcatcaagaggtggatttaagcatgccaaacagataacaatactcttgctccaacaatcaagtgccttacgacaggccatcggcttgttcatgttcgttacgctcaagttcactaactaacccagtctctacggcccagcctgttcccagcactacacagccagcccttccagcgtcgattcaattcgtcgattccccagaaggccgaagctgccctggacaccgtcgagcgcgacatcgagaagaccgcagatgctgcttctaacctgaccgaaaaggtgctggacaaggtggctcccatccaaacccatatccagcagttccccgaccacgtttccacgcacgcccccgacaccatcggctacttccagtcgcttgacatcaccggctctctgtggtctctttggccctcggacatctacctcaatctgctcgagcacgtgcacgtgtacactggcttgccatggtgggctgccattgcttccaccactgtcattgtgcgagttctgctgttccctctgtttgtccaggctgccaacgagcagggcaagatgtctgaggtcaagcccgagctcaacgtgattgacgagaagctcaagtcggctgccaacatgactgagatgcagatggttgcccacgaaaagaagaagattctcaagaagtacggaatctcccagatgaagctgttctaccccatggctatgttccctctcaccattggtattttccttggtattcgacgaatgtgcgagattggcggagtgcagggtctgtccacggagggtgtgctgtggttccagaacctggctgccccggatccctacctgggtctgcaggtcatcactgccgccatgtacatggcatccatccgactcggatctgagactggcaccaacaacctctctcccggcatgaagaagattctgcagtgggctccctggatctctgtgcccttcctgatgaagatgcccgccgccctgctgctacatttcttcgtcaacggtatccttatgctgatccagggagtggctctgcgaaaccccttctttcgaaagaagttgggcattcacgagatagttccccttcccgcggctgctcctggcgcctccggcaagaccgactccgttcgagatacgattcgaaacgccatcgacaagcgaaagcgagatgctgccatgcagaagaaggaggacgataagaacgccgagctctccaagcttgctgccaagcgagccgagggtgttgttctcaagcgacgaaagtagccgtatgtatatagttagtatgatgtttagtttagcaagcggaaaaagtggtgctcgcaagtgtttaagctgattagtcggaggactttagacatgggcgcacttaaaaacactcagccaggcttgtcgcgtcaaaaaaagcaattacaagtatgtactgtagcggtagcagtgcctgacattgtgcctgaataatagatatagatgtataaccaaccaattatattgagcggcaacaacaacttcggtgtgatctctccaaccatgtgtcttcatcggttttactttgtacttcgtacataccccacgctcgtcggagaaaaaagacgattacggatatgcactgctaaattgagacatggaagagagagcagtacttactgtacaggcctcggacaagtacaagccaagcagccgttgaattatagcatgcgggcaacacagagcgcatctcatcccccaatagagacggacatttattacaccacttaaccgcgcccaacggcccaaaagtgctttttcgttcgtattagttggtcacccctcctacagagcagtcccaaaaccacaccatagaagcgtatctgtacggcccataaggaaaagggtgcatgagacaatttcagttttaaacaccaccttacagaccctgaatataccccctgataggttagccaagcctagcaatcgacacgccatgggatggggaaagaaatcgtcgtcatcggcggtccctaagccgcctgcacaaccgcccaaatcaccagccaaaccgccgtcttcttcagcatcgcagcctagctcccgtgatccggccatagttccacgcgcagactgcaagaagaactattactaccagcagatgttgcatcgccagctgaatgatgatggtagcaccgacaacctggccacgcgcaacagcttttcgtcgtccgagaacaagacaatccgagaagacattcgcatgggagatcaggaggtgctgcgtgacatccgcgagctcaagagcgctggaagcaacgtccgcagatcgcgatcgccccagttgcggccgcctagcgtccaccaacggcttccctcggacgattccatgtccaattcgagtgagtacagttatcgcgacacaagacccacactaatgacaagctaacacagccgactactatgtggaacctctaaacaggtgagtggattcacaagcgcagcgcaaggacgtattcgttacgtcactagaggaccaggtgcatagcccgatggcggccagtctcagacctaatttccgcagttttccgatccactgaaatattctggtccacaaatatttgtccgaatatttagaccggaacaaggcgcgttttttgtgtttctggttcggtaccacgctactgttggtgcgcacattgcaatgtactctcacgagctacctatgctgtagtctccttttttagcgcccccccccactaacccagtcctctgccttccatatccacgtcagacacgtctctgacagcttccacggcattttcccgtgaccgtgagtataacaacgttgctacagcaagggcctcaactattacgctcgtacacccctgacgatacagacgctcgatgagagagatgttactacgctatttgagtttaaggggtaagcgatttgggcttccatttggactctgatttggaactcccgatcctgattcttagctcttagctcttgtgacgtgtgagggaaaaaaaaagcaacgacaccgtttttttgcttctcgtacatctgcccctgcaatgtccacttgtggcacccctcgctgtctctccaaccgtcgcgtataatatcgagctcagttatcgaggctactaagcagccttcgttaaccccttgaagatcctaacccaatagacccgtcagtggtgaactcaaaagctgcggtggccagtgtgaaatccgctaaatcggatatcagcatgagaagtacatcgaaatccgtggagcgaaatccattcaccggagtgattactaccaagtgagtatgagtggaggaagtggttaacgaatggccctgggaacggtcagtgctatgtgtggtgttctccttttacccctggtttacgatgcacggtccttttatgagaaaacgcgttaagctttcgccagccgtctcacaatctgcagtcccaagaaagacgacacatgagtctcgcgaaagcgcacgacacgacaccatacacaaaaacaaccacacacacacacaaaaagtccacaccagacaagcacacagacaccacaacataaaccacacaaatcagcctgctaactccagacacgacagtatgtatcctcacactgccccaaacgatgggatgaaaaagacagctccagctaacacagtggaacacgaaggttggctcaacaactcgctaacgccaggcgcacaatggcgcttgtcccgaggagtggtaagaaatggtcaactgctggtatacaagccgccgtccgatctatccaaccgattcctcgaccccgacgccccccgaacacaaccctcgtcgacacacactgccatttcagcaccgttcaacgccgctccagtgtccgatggcatgctgtcgcatgcctcagctgagcctcatccgtcactcgaactcgattccagcggcactcgcatcatgggaggcactgtggaagctgtgtgccaccagcttctgtttggagacgacgatctgctcgcggaatcgatagtctacgtgctgcccctattcacagatgtggtttatgcactggacaagatgtgcgagtacataattggacccgtcagagacagccgctcgagcttggcacgctaccaagaacgagccgtggcccgagctgccatggctgtgcgaaagatccaagacgacttttcaggcatgctgctggaaacatccatctgctcggctttgcttaaactcattgacggtattggtgctctgtcggaccaggtgagcaccgatctcaaggtcagcgtcttcaaaaaacagcgccacatgggcgatctgcttacccccagtcgagagggtactctgtggtcagtacaaccaaaactaccagaatccgtcaacgagcggctgcaatcatttctggtgttcaccgagcaacagaaccagcttggtgctatgcaatcgtcgtctgcgtcgtcgtcgtcatcgcactcttcacaattcggctcgtcgtcgagcccccagacgttcccacccgacctcttcctcgacactagcattgatcttctcgcatcgcaggtctactactttcacctgcagttttcaggcgcatggtcgcctgcgtcagacatgtcgctgctgtttggtggtcgatggaactactggcgccacaatccgctcatcttcgactctctgtcggtccactttttaggaggagttctgctggagcacctgttttctggctctggcgcggtgtcatctgcctacagaggcaagctactctcgcattggatctcgcttggaaacgccctcaagaactgtggcgacatggttggctggctaggcattgcgggagttgtctgctcaccacctgtactgcgtctacgagactcatggggctttgtgtccacggaaatcaaggattctgttaccaaggaatgggcccccgtggtgtttgacttagagcggcgtctcagagtcaccgacatgtcgcgaaagtctacatatcacgtgcttgcgccccagggcattggccagagctaccccaaggagcgggtggtcccatttttcggcgacctgtgtgtccgatacgaagatggatcatccttccgtcagtgcgagtcgcgtctgaaccgtatccgtactgcatttgagcggtggcagacgtacctggatcaggtacctcagatcgacacctttgactctgccgccgagcccatctccgcactccaacgaatgctgtactacctgttgaaccgccattcacagggaaacattcccttccacgtgtccaacaaggagcccatctctgcgctgctgaaaatgtcgctgcagtgcgaaccgtcgtccagtgggcgatacctgccccacttttataatcagcagcttcctctgctgatgggcagttttgtacccaccgtgttcacagacgtgactccgtcgtatcggctcttttccaagaccgatctgctcacttttgcaggatttggctccccaaccaagagaagtggcactggcatttcgtcacctcttcggtctctgccttctggtacttctggcactgaggtggatcagtttgcccggcggtatgtgagccagttcagtacgcagcatcctctgatttgttccttgcgagacatcatgaatgtgggctctagcatgatccagggcgatgacgtacttctcaaggtggtttctgagggccctgagggctcagatcctactgtcgttgtcaaagctgcttctttggaccggcttattgacattctgatccttggtgtgggacattttgctcctcgggtcaagatggacatggatctatacacactgacgtttttcgcgacattccggtccttctgctcgcccacccagttgctggacgcgtttcgacgacggtttgtgggcgcccagtctggctccacgtctcttacaatgcctagaacttttgatcaaaagttccccgactgggattccactcacatccccgagaagcagcccgactacagactgatggcccagatacagattggcattcttgaggcctgcttcctgtgggtgtcgcagtactttatcgactttgtcaatgagtacgctgtcagagagctctttctggactttttggccactctggaggttgagatctctcgatggggaagtgttgtgttcaacagtgaagacattgttctctaccgagagtctctcgagggtctgcacaagaagctgcgaaaattgttcatcaagaagagctatcggcccgtgtctgcccctcccaagatcccttactttggtccttcatccaaatacatccagatgcccatcaattgcggtatcagcgatgttgagtcttggatttctgaggtggatctgatggctgcccacatctttgctctggtgcctctgaaggactggatgtctctatacgagactctggaggtacagggcgtggagccattgggcttctttgcattccgaacgccctctatggccaccgaagacgaggttattgtgcagagcgtctacacctactttgagacgcttttccgtgacaagcccgaggaccgggtgcttttgaacctcccctttgcagtacaggaactgttgcgactccacaacaactttgttagctacctgactgcccagttgacggacctgtccattagacccgaaattcgagtggctcgaatggagacgttgctcaagggcattggcatttgtcgtcgacgaatgaaggctgctcgggtgtttgaaatgtcgcccatggccgatcccgaagagggaccccctcctctgtctccctcggttgctcctgccatcccctcctttgtggaggttgctttggcggctgcagccatccgacccgagtcccggctcttcaccggctcgtggtttgctgctgccaaggagtgtggttcatccactgccgactctctggagtccatcataccgtacgtggatggccagctccagaacaagcctctgactccctgtgtaggctggctgattgagcgaatgttggaggcgtcgtgtcacgtgcccaacatgtgtgtggaaactcccaagctcatcaactttgacaagcggcggtacgcctacaatctggtggggaatgtgtgcgacattagacccctagatgaacagcaggacatgaacttgcccgaacagaccaagcgaatgagctttttgatcaacctgtccaaggcttcgtttgcaattgaccgtaaggtgaccaaggagcatgccgcccgcgaagccaaggcctatggcaagtctaagaaccgggtttttacccactgtgtgggtgctgagctggagaagatcaagcgagatgttcgacagcgagaggttctcgatcgaaagcgccaacacgccgttcgagcgcccacctcgtcttccaactcggaaaagcgaggcaagtcgcgtctgggaggctttctcaaggctgtgcgacccatatccatggctctgggctcgtcttggactcctccgcaatcccaggaggcatctggaatcaatcccctggatctccccaccttttcggtggacaaggtcaagccgttcagatccattcctctcggtcactccgacattttccctgtgcatgcgctgtccaagtccatgttcaagattgtggactcttcgggcgagtactcgttccaggctgcgtctgaggccgacagcgagatttggctcaaggcgctcactcgggccaagaacagtgctcctcagacgagccagtccactcgacagatgggtcgggtgtttggcgtgcccgttgctgttgtctgcgaacgagagcaggctgctattccttacatttgtgaggtgttacttaacgagattgaggctcgaggtctggacgaggttggtctgtatcgaatttccggttctctcaacaacgtcaatgctctcaaacaggcctttgacaatggtgagcgtcccgatatgaacgacgaccgatggtatgatgtcaacactctggcaggctgctttaagctgtatctgcgagagatgcccgagccgctgcttcctctggagctgctccctgactttgtgtcttccaccacaggtccacagcctgacctggctggccttcgagctgctgccgatcgaatgccggcacccaacctcaatttgctgcgacgtctggtgcaacatctgtctctggtgaccacgcacggcgagcagaaccgaatgcatgcggtaaacctggccattgtgttctccatgtccctgttgccgcccaatgcctcggccaatgtttctacggatctcagcagtatgcagacggttctcaagctgctcattatccactgcgatggagtgtttggcagcctggatggaggatctactacggttgtcgatggtgcatcgacaccatcgtctggccagctggaggcccccgacatggcttcgctgactctgtccgagtccaagtcgacttcaacggtggactctctagagatgatgcaggcgcccacttctcgtcgacgacagcctgcgggccaaaaccctaacagacgattttccgtgctcaatgagggcaccaacttttctgacctggctcatcagtttgggtctcaggagagtttgcattaaaaatatacacgtgtagacactaatgaatgatttattgatacagatttggatcgtgtgtctcagactccccgcgttctcgtgtatcgcgtagtgtgagacattcaacgtggatgctcgtattcatggagtgtataatattgccgattctatagaaagaacgtacttgtatattataggttgtgtgtgttacatacttgtacttatactgtatgtgctgctcatatacaatgtacaagtacaaacttgttccaaaataattcagtctgtagctactgtacttttaccagctgtctataatgttacaatcgttgcttcgtgtgccatgaggggaagcaactgaaggtatagtcaattcagtgcagacctgaaacaattagctacatgtactcgtactcgtagacttcgcctgtttctccaccacaacgttaccggaagaatttgacagggtatgttccgggttacaatttttgaacgttctctggggtgggactgttggggttacatacgtcattgtcttggagaggaatgtagagtgatgcgacgaggggctgtaaggttcataagcggatgtgtatatagaagcgcttgttgtatatagttaccgtggtatatatagttaccgctgaatgagccgtgtagatttcgttttcgctattactgtttcttctttgccatggtgccgttcacgatgccgtgcatttaccccacgtgagtgatgcacggtgggtcttccggggtaaccgggagcggtgggcgttagtttgacgcacttgtacccactaccggtatatacgtattcgaactatacatgcggcattggtctatggaggtggtggcaatggtagatagttcagatcggtagccgtgttggatgttgctcaaatggagtggtccagttggcttaaggttcggtcggaaaaaatagacgggaaaacagactgaagatacttgtagagtgggaatgatgagtgggagacactgggcagggtgtaccacacaattatgagcaagagaaaggcaacaaagtcgttcttgtcatcagatacgagcacacactataaatatgatactcagactgcaccatcttaaccactacatcttcgctacgaacacctcggttaaattttgagcttcccctctgaaccctctccacctgggtttatgttccggagaaatacggaactcagaaccgaggggcaagcggatttagagccagatggggggtgcatggacttactgtagtgcaaccaagaggccggtaaaatggatgggtgtcgtacgagtaccgttacttgtatttgggtgtttagagagagagagagagagagagagagagagagagagagatagagcgagagacggaaggagatatttgtgcaataataaagaacatataagtacaatggtccgaattgggtgtccagtaggtagtaaccatatggtacttgtacgtagaagtagcctgcttgcacagacgtctttcatatgcaactccagagactccactgaagtcagacattgccatttcggaacaacagtctcaaacgcccaaccgtcagggcatgaacttcctgggaaccttctctacgatacacaacctccaccagccagtcaaaacagtcctttagcaaacttgccctgtatgagagacatttgccgcaggatgacgtcaggaggaccaggatctgcgacgagcatgagggtagcgtgcgatatcggcgaatatggcatggtatgagtcatggcaataatgatttgagcgacatggcaatatgagcgtcatggttatttcgcgtgtatacaaacatttccattgacccgtgtaccatgtgccttcaaccgaggaggttatactcaacgcacaaacaacacatctgttggctgttgggaagaagaccgggtggaactgtgcccgctatggactattcgctcggaggtagctcgcgcaaggacgcagctcagtctacagccgacgcatagcttcgctcttccctacctggtccttccctacctggtccttccatgcctccctctgttgatactccggtctcacctttgtagtaatttatcccgacatatccccatttatcccatccgcatccgcaggggcggaatccgaacggagggtccaattcggtaaaagccgagaaagcggcaaaataaagcgataatggatatattattgtctgtagatgaaaaaattgttcaccagtattgatccgagcaggcagcttcgacaaatgctttctatgtgtagatataattactgttgccaaaccacacaagcactctctaccaactgccgttataggatgtctaccagtacacactcacagatggcacatacggttatcggccatgtggattccaacatgtcacatgtatggtactcgtagtaatctggggtgcgctttaaggggcacggaccatgttcggaggtgtaatgagaatgcttgagcaccgttggtgtggtgacacgtcgtaggattgtcgtgaacacatttcttccacgtcagttttcagttgcaatattctgaatattatgtctcagctaaattaccccaccaccgccgctacgtgtagactggttacccgttccagtggcatgtacccacacaatctcccgatcacccttcaactgtcgtacaaagtagcacctccgtctaacctcttttggtaactcaccccagacatttctccccacccccaccatgtctgaactttaaccgtttgagggtctggaggggacgtggatacggtggatacggttagaatgagtcagagagttgctatagcgcgtgtaaaacctgcccagcgacttctccacgtcgctagggcccagacagtgctctccagaacgttttcaactcggccaaccttatttccaacaacggcttaccgagccagatgccgacgataatgcacgacaaagaaactatgtaagctacagacggttttcacttgcgctcaaacacacgataagacgataatggtaatgagggggattgttgaaaatcggtctagaactcgttgtagaacatctaagacgtcgactgaacgtcccagtcagtctcctctcgaatccgattttaaccatccaccttctatttccagccgcccacccaaatgagcgctgtttcgagtgttaaacagtcctggcagcggcagctcggatcaattttcacactttctttggctctggttttcacgcggcaaaccccacacggtgggatgaaacaacatgggtgaatgtaaaggatggatttggtgtgggaaaaatatgataatttgacataaattcggacaaaaatattacttttattataccgtgtttttccattttacaaaaatatatactgctctaataatccctcctcccaaaacacaacaacctcgtatggtgtaattccggcagcactttaatttagccggtcggccgactcaaaatggacctggccacacaatgtaaccgaagcccattcatgtattgcttgctgcagcaccacacactgctaccgacgttccggtggttctagaccgcagtgaccccagaatatatggattcgccctttcggcgccacacgcgtgttttggtaatttttttccgatttctaagtctctctcagcctaacaattaatctagaaccaccttgtatttgcacctaaacgtcggaagacagattagggaaaaatccgagatattttccagcgctcatatactaattatcaatcgccaacctctggcgcaaacgtgaaatcgaggcccccaacgaaaggctatagattgtgtggttttctcacgggcatgctctcacgtgcgtcggaaaggctatacggaaaaaaaagtgagcctgagtcaagaggtctcggaataaattggcactgctgaaaaaaattgactgtcgagttatattgctgtgttgatgggcttcaagtggggccacacctcagagtagaggtatcatgactcctgccgcacaagacccgggcggctgtcagcgccgtgtttacatttttccgtggttccgggaccgccctttgcattttcactcatgtatctatattttgtagccgcagaaacctcctccacattttccccagccgaacaaggttcggatgcatcggtagaaacggagtctaaaagctgggagagcctacgaaaaagagaccacactcagcagcacaccctaaagggcccaaacccaccaaaaaagaggaaaacagagttatggacttagctctgtgtgcatgtgcggagtagataggatactgcatcctgttgattgtatgatatataatggctccatccccagatatcaaaatagatcgactcgcaacttcaatgtctgatactgaacaacacggtgcggttcccccgcgaaagagaaccaaggtgtctagagcctgcgacgaggtgagtgtgttttgggatgctttgtggtcttaagtggccttctggaggtggtaacagcttgaggaggatgcaaattgatgttttgagggtcagagggtggctgggagcgtctccaccgcccgctttacaccccagagtgactctaccccctcttctgaattcggtggatgtgttgtgtgttgtgttgcgggtgtgacgacacggaacagctcggaacatttacccacgccacacttgacaagacatcgactggggtttgtgcaccagggaaccgaaaactacgactggtggcgctatcttcgtgcacaaactgatggggtgattttacccagacactcccatcatttggggaatggcaccaccgatcgccctaccatgttgctatttgcttacactcttccccagaattaaactaactcagtgtcgtcggaaaaaagtaagtgaaccttgtgctccacatgaaaacggaattttccggtgcttgacttgtgctgcgccttcccctcttttcggccgatggcggacgaagggttgaacggaaataatcgaaaagtgggaaaaatggaatctcgacattttgggcggattctcggctaccgactggaagaaattatttcgacaggttgtcagtggggctcgccaggcagaaattcggcgacttgggaatttttccttttgccaaaatctggccttttgggcccgactccacccgactccagccgcaccgttccggccccacgcgacttttgggcggctcggccctcggcgacttttagggaagcttattgcggacaggctttccataagttgtggtcacgataactcgcccaaaaccccggcccaaccttaatttttacacttcattttgcgccgctgtcattggcccgtcgattccgaagaggggactctgtctaaaagcctcttttatccgaacctggaatccgttgccgagcgtgataaattgagtgactggcagacgtccaaaagcaaataccatacaacaaacaactaacccagattcgatgtgatgctgctcccgataagcccacagattcgagatgctcgtcttgccgaaagaccggagaaacatgcactttcagccgtgtccctatgaagagaggacctaccaaagggtgagtattatgacggaggattttcggacaactcagagagagggtcggtcagatgcggcactgcggcactgctgccctttctttcaggctgtcgtgtgctgccgattatgcactaaatgactcatgagtcaaccaactctattttgcctggaccctgaacctgattactaaccctacagacacagaagagaatccacctcttcgttcagcagaacatcgcaaccggtgttcatccaccccaagtccgagaaggacctcatgtcgcccacggcggatgagctagctcctgtcttcccgccttcgccaccagtcaatgcgcctggagctgcttgctccgactaccccatgcgaaagcgggcattttctcagacacacaggttctcgactgccttccatccacgcactgaatttcacccgtcctgtttcccctcaacagcaacagctgcagcaggctgcacctggagctcctgcgtcggtgccccccatggacatgtaccgacccaacatgttcttcaaggtcgatcgacgggcctctctgcccggctaccctcctaacatgaccatgcccaaccctgcacccaagagtgaggggtacgcaccctcccaggtcagcaacagtcctcctcacagcagcttttcgtcccaccagacacagcagccccacagcatgggccaagcaactgccacgccacccccctcgcgcagcgaagaaaagtacctcgataactactaccaggtggtgcatccaattctacccattctcccccccaaggccgttgtcgaacagtggctggtacaggctgagccaaccgtcggcgcaaaactcagagagtgtctgttgctggcactcaaaaacatctatgtgtctagtggcggagctcagactggttctgagtccgtggctcgccagctgtgtgaattgcagattgcattggccagcagcgagactgtatcagatctgtctctgggttctgccaagcaagcaattagcaacaacacctgttccactgccgccacaacccacattctgcatctcatgatccagctgctggtgtttgtgcagacccaggactactcccgactggctacctctgtggcccagggttatgctctcggcatccacaccatttacgctaccggcaagcgacccgagtttgagtctgcgctcaacctcatgacacaccacaacaacgaggccacctcgacacacaacaacgttgacaacgagtccatctgggacacatgttaccgactgcacatgctggtttttgtgctggaccgtctgcactcgctgcgaatgagcacccctgctctcatggacccccaactcgtgttggtgactctgtgtgatggtctgcccaaggtgctgctcaagctgcagggcctcaatttcctagtggccttggctctgtctgtggccactcctgaaactcagtcgttctcgctacagcgacacgagtggttcaaaaagtctttgctgcagcccggaaatccttccctcacccaacacgcctttgatagactaatgcagagtgttcgaggccaggctgtttcctgggccaaggccatgagtctgtacgccgaggctattcgacagtaccagcagcagcagggctgggagaagattctctctactatctcttctctggttgacactgtagacacctctttgatggctgctgtgcctctcatttctgagtactttgtccacgaggtgatttctctaatctccggcctggtgtctgcatttggatctgaaatcgattacgaagccgtccacatggctggagaggttgtcgagcgacgattcccccagcaggtcaaccactggaagctggctgtggcccccaagttgcccaagaatgatgtggctgatgccgtggtgatggctgccgttaactcggcgcactctagcgcacctcccagcgccacgaccgcgtcgaccgcctcttccacatcatctctctcctccccgccgccaatgagcatccgaacgcttccgccggccggatctctgggtcaccagcaaggcttcatgcagaagccttttgacaagagtcttctggagggcctggcaagtgttgccatgcaccgacctagacactgattatttatagctaacttatgttatttttacaatacaagaaaagtacagtacaaatacccccacctgtaggagcggtgatggacgacacttgcgattgatgaccatacttgtactgcagatgctatggtcttaagaggtcgagctgcagatggagtcacatcgtacttctagagttcaaattatagtgattccgcagacagtagatacagtaagcaccagtatgtacaggtacagcaatacatactgtgccggtattgtatgtagctactgacatacaactgtactgtacatatacttgtatgtactgttctgtagatgtagaaggtatcactttggtcttactcgcagactggagatcagatgatgattacaagttcagtatgtacatactgtacagtatgtacgtaccagtgcaattggtggcgcgcacccgcaatctgccgtttgtccacgatccagtgacaatggtgtcttatactgcagttcccacgcttctccaaaaagcactccctaaatgacgacactgaacaatggttttaagtgcttcagctatccccttcatcatggctataggagtcctgattaggtatactactgtacatgaatcaaaccagtttctgaagtgtttagggttctcgcaccaatttcgtcacgctgtaccagagccccaaacgcaaccacccaaatctgcaccaagcatagcgtgtcgtgaactgctgtaaagataaatgtaacatcttcaacgaggaagcaaaaagattatggtccctagcaggatcgaactgctgatcttcgcgttgcaaagctgctattcttattagcacgacgccttaaccaactgggccaagggaccgttttttggccaagaagatataacccagtcggttgcgaagggaacgccgaatctcggcgaaaaacgaatttcgagtgtggataagacatgagacgattgatatgatatggttgattttctagtcttgattcgctaccacgagaccgcgacaaggacaagaacaagatgaagcgacgacgaaccaactgacacgcgcctcgaaacgcacattgcaacgattattgtatgtgtattgaacgccaataacacggcttactaggtatatagctgtaatgaaacattagaataaaaaaacccttacaagttttcggaatacctgataagcgctctaatttgtcataggtacccccctcccccaaatgggaatacaagcatgtagatcagtctccacaacacgtagttgatttgaatagcttcgaatattcaactaaaagaataatgaaagtgtacttatgctgtaacgactttagttgtgaggattggctactagacacactggaagtaacccccttatgtggtatttgatggtgaaatgatagtggaaatatcgagtgaccattacgataataacagaaggaacaatcaaacgatacaagtataatagctacttgtagtatcaatgattacaaatcctaccagatttctttgatcacattccattacagatgttggttatcttaaaacgaagatctacatcattttgcgcatctgagacacggaccccagtccgttttacacccgaattaccatgtctggagctcattaccacgttcagagctcattatgatagctgtcaatgtcaatcataaatcgcgtattgatatctgcagttctgtacaagaatcataataggggatttttatcataaaactgttccacctccacttaaccagaatacagatctacaggatttcctaatgcggtaaaaacacccaacctcgtcacaaaatgtcgttctagaacccattgtaatttgtcacccatgctatcacccacccgactacaagtagcagctagcaactgtcacctactgccaagtctcgctatgcattatccctgcatgggcgagtacagtatgtgcagtagctacagctgcatctcctccctctcacaatacatgataagtaatgtctacgatgctcttcaattactcaattactcgtttggaaattacaaggccccttcgattatagaaatggctctacataagagattgactcttccgtatcgccttctgtagacacagaatacggtttgcatacatgagtattactgtagcagtatgtacttgtagctacagtaagtgtactatacctataatcactgcacttcactgcacttatgacatagccacaaccgtcaatacattctctatatctctggttttcataaacgtcggttgtatgatcttcaaatgtgacatacccctgtctctgcagtgacagctgaaaatgacatcgatacctcggcttcagatgtaacaaccaacagcattctgtctatgtgcttcgttgtttatgatatttctacaaatgtaatggatcatgcatcttagttatattcaaaccctcgcaatatcgtcgctatgttggagatgttagagtccacttcactcgcagtgactgcatctaaggtttcaattaagtgtcgggaagcgaggggttactttggaagccttggctgaagattcttgggaagcagtcggttttggagtagataaatatagtcgatagggcagttgaaaaaatggtcttctagctccaaggactcgtttccatgttataaaattaaaattggacagctcctgatccgctttccggagctctctccatcaagatgcaggtacagggacatacacaatccgcagtttgaaggtataacaaggaactattagatcacataccaagtctgttaatcgtctctgggaatattgcccaccctctattcaatcttaaactccagtatggagctcatagcagagttagctttgagagacctacttgtagcatgcgttggttacatggaacagatcattaggctaatacatgttgtagtacagtatgtaccacacaacagtaccagtatataaatgtagaggattcagcataggaggtgatagaagcagcagtgacattcagtcagtctaatttgtatcacacaagttgcaagtgagtatggagagatggactggacttccatcatcgagaagatgtcacaggattgtctgttggcaggaagtctacagctagttgtggtacagtaccattggaagtggcggtggactattaagagttgaagttgttgatgtttctgagaatgcttatcgatcttggaaacgttcaccactgtcagcttatgctcagaacaactcaatgacaacctttccaactcagtacctcagttaattatctcctttgctaatttcagtgctctcgttcattgccctctttcttcttgttgctcaggctctcgcgcaaacggctcctatcacccaggagacatacgactttgttctcaagtacggatggctatctaacgtggcctattgtgtcagagcccctggcccatttgccctgcagagcgattttacctgtggaaactcttgcgctcattttcccgatgtgactcttgactaccagtttggaggaaatttcttctcgacttcagttactggatttttggcccacgatcacaccaaaaaggaaaagtatattgttttccgaggcactttctccattgcagacgctattactgacatccaaacgatccaacaaccctacatgaccagtatccctcctcttaacactactgacataaactccacaaacccttctgccagtatcaattgtcctggctgccaagttcatgatggctttcagaaggcatacagagagactatggtgaacgtacaggatcgtctggtcgacttccttggaaacaacactgactacaaattgatcgtaactggccactctctaggagctgtcactgctctattcatgggcatcaacctgaagaatcttggatatgatccaacgctaatcaactatgggcagcctcgacttggaaacaaggcttttgcagactacgtggacgctctgttctttaagcaaggagacgacggacttaccatcaaccccgaaagacggatgtaccgagtcactcactggaacgacttctttgttggatggcccgctggttattcacatactctgggagaagtttacatcagtgatcccacaggtattaatgctcctattgaagatgtctattcctgcgctggaccagagaataatcagtgtcaccatggatcattcaatcttctagaacgactcaacattctcaagaaccattgcggttatctcaattggattttctactgtgctatcaatgtggacaagagagagatgatgattgatcctccccgagttggcaagagagttgagcattggagtggcaagttttctgatgttgaatcgacagaaggcctgatgtatgaggccatttatcctatgtaattgaatcacaccaaccttttccgagccattctcaaacacttatacttaatgagtattgttaatactgtatgtgcagtacatactgtagcaccataaccgaccactgttttctcttgtttgtacgatttttttacgtctttacctgtgcaataatacataataatttactattcctccatgctatacaactacaggttggcaggtccctcgagttggttgtacatgggacaactcttgttggttcgaatgtggccatatgcaccacagttcttgcactgtcgcggacccttgcctttgccgacacccttgcctgaagggggaggagtgtcggtgccgaggttgattgtgttgagaccctgcttctgggcctgtcgctgctttcgtcgctcgcccttctttcgcagatcctccagccgctcctccagcagccgcttgtttcgcttgttggcctcctcgtcgttggtggggtctaagtcgtcgagtgttagcttggcctcgtccatcagctttcgtcgtcgaatgtatgctcgaatgacactggggtccttgatggtctcgacctttcgctggatgataccgtgctcgtccttgaccattcgcgtgattcgcagcaccttgttgcgctgctgcatggccgagtcgcctgacatgagcgacatgttatcatcgtcggggaaggctgcgctagtgaaaccaggcgtagacacccgctcttgttgttctcgctgctcctcagcatcggcccattttgaatcttcgtcgttctcttcaggtaccttggtgttgctgagagctcgacactgggcataccagattcggctgatctcatcgtcgtatgcacgctgctggtgggccacgttgtacttgtgtccgccaaacttgctcttgtcaagcttctcattgacagactcaccagcggcctgaaaaccacccttcatggaagtcttgaggaatgagaaaccctcgcctcgaccagaaggatcaccctcgccatgcagctgcagcatggccttgccctgggtagcgttgatgaagtttctggtcaggttccatggagcagactgctcctccagagaaagaccagactcctcgccattctcatggtcgctctcaatgtcgtcagttcgaccatatccagcatcctcaaggttctgaacaccaacctgcatggcctccaagagagtgatgtcctcgggtgtgatcatggttctgatgccgtcctcgccaggaagagtatcggtaggcttgaccttccagtaaccctgatcctcacctgttcgctgatactccataaactccttgagcctctgtcggttttgagtgtcaatctgatcagggaaatgttcggcgatatccttcacgttgattctatgataaggtgatgcgtttagcactcgatagacaatcatcttgagccggtttttggaagccgtggttacctttcgagagtgtggcccgggtacgtcagtcacggggtatgtttgaccgacagtgaagacatgtggaatatttctcagaaagtacttttggccagccccagtcacatcgcctccagttgatcggatcataagaaaatctgtgtcacgtggtgtatgcttgaatacgggggctcggatcatcttgttgtacagagtaggcacaatcttacccggctcgacgaatccaaagttccaaaagggagacttgtcctggaccgacagaacatgtgtctctccaacggggagcttaggtcgggaagtatcctcaggagaagcttttctgtaatagttgatcatcttagagcccattccgtagttggagagggtcatggggaattgctcagcgtactccatgaggaagtactgagcagagtcacccaacgacaagtccgtagtcttggccaaaagatccttgataggctttcccctgtctcgcttcttctttcggatcttcattcgcgaaaagtgaacagtagtgttgggtttcaccacaaatgatggccgatggaacgaacgagcctgaggcttcgagattcgcactttgtagaatggactttgcagtcggagagctggcatggagtgatcgatagacagattgccaatagtggctcgtaccttgctctgtgtgttctccttgagcatatcgtaggctcggtcgttactgaggttaaatctgtttcgaagctgtagttcggtggagggaatggcaggagtcacattcttcgatacacgaccatctgtgttgatgaacagtaggttggggtcgttcatatcgaggttgaccttcttcacctgactgagagcatcgccttcaaacaaggcctcgtcgttccaggcctcttcgtttctgtgcacgccgagctgtggaacaacctctttttgttcctccttgaccttttcgccctcgcaatccatatccacgtctccatccccatcatcctcatctccccacgtgatcttccagtcagtaatgtcgaaatgcagctgctggtctgttgctgattgtgtggttctgctttctcgggccagttcctgcttatcgtcccccgtctcggcctcggtgactgttacaacacccggtcgccgcttagcatggtccacccacactgttcctcgtgtcatcttacgctcatctggcgccacctccagcttagtctttgtggggacacacggacgagcagtgttaggcttgggcagactcagaacagcaaacttgttgtagaagagcgagttcatcttcataggcttgcccttttggaacccggggaagtacattgcaagcatgtcaagatcagcctgacgcgccatctgtgcaatttcctccagattgagctcctggatgttcatgtgttggatgtcatcaaatccagaggcgtccatcttgtcggcaggccctaactttcccagttcgcctagctcatctgcgtcaagcttcatgtccagcccgtcgcctccagcagcctccatctccatctcttcgtctgactctccaggttcaccggcatgcacgacatggttgttgctgttggcattgttattcaacattccagcatggacaacaccaccatcatcgtactcgtccatcacaggcagctcgtccatttcgttgcctccccagctctggctccaatgttcgtcatctcccagatcaaatcctccaagctcatcctcgccaatgtggaactggaagccacccaggctatcgttcccagacatggatagaccagcttcctcctcgacaatcatctcctcatcctcctcaatcacgttgtttccggttgcttcctcctcttcgggcagctcatcatctgccagctcgtcttcgtcctcgaaatcgatggcgtctgcggagtgtttgatggcatctgcaccatcaagcgatgggacaacacctccaacgttggtagggtcgccaccgagtgctctggcccagtcagcgtcttcgtcggccatttctgtttgtgtaactcttgcacggggtgtaaatgtagctgcatattggatttaagattcagggctagggttgattacataaggctagcggatgaagagcatgctatctagtgatagattggatgatgaccaaatccagacgacaaggaaatatttctaaatggtgataaagggaaatggccattcgattttggacagtttggtacattgccacgagtctttattgagtcaatagcctctcgaggtgtatataaaagtcagcgcatgcactgacccgaacacatactgtataacgtgtatgattaaatcctaacatttatataaccaacataccgactacttgtagattctatattactttgtacactaagcactttgtgagtcatgtctttgttacaagtattggttgctgatcatcattatcctcactcctgttgttgttatgaagtgtggtttttatagttgggtttcttctcctgcatatcaagatctttacgcgctgggtcaagcttaacaagttcagaagaactcattcactactcaatttcgattttttggcacaacgagctgtcttttggactcgccacatggaagacagattacagcaaagggtacgggagactttgtcactaccgaaagtcttcgaccggctggactcctattttctattcttttcggcatggtacagacgcgtttccaaggactacacattacaagaaccggaggaatatgagaaggagcgtcagaatgccgcctttatcgtcgacaatgattcaaacacgggcgaggaggttgtgagagtgaccagagatcacgtgccttgggtggtgcttgctgctcacttcatgacggggtgctctacgaatgctacttacgtgagcgaactgctagagaaacgactcaacattggaagaattccgaaggagatggttgagagtatcattgcatggagtatatctggcatgcatatggacgagaagctggcattgcaagctctggaggcacggcttgacgagacggagagtggcagggccttgacccaaagcttgaaggataagatgcagaggacgatttgggacaaggtgtttcagcatcatctgaagaattcgcaattaaacccaatctgcgaacgacccggagttgtgttttttgccctgtttcctttgtctaacgcgaatggatattctctgctcttcatcgattatctcaccaaggctgccacattcagcataccttgcaaacccaaaaacgcgctggacctgatcagggacattcgggtcgccgttttggatcatttaagagcatacggacagcccttggccctaatttgcatgaacccctgtcgaggaacgaacggatggcttggaagcgtacttcagaaggcattcaagcacatggtacctttcgatacggtagtgtccatctacgaacttcgggcccgctcacttccatcccgaatagctgaagttttcgaagaagcaactacagctgtgagagaccccaatgataccttgaaaaatagccaaccattctgtttcctcagaacccagaacacccacgagacttgggagcatctcgtgttgggccattttatgactcttcagaatcgctcctttgtaagacatcctcgagacctggagtcgggtgctacatctgataatatgaatatctgttttcacatcatctacgaagtgaatctctctctgccttcatctaagataagcaacgaggcatggtcttgtatattctttcccaatccctttccaaaagcgaagcttgacctattcaagccagagaaaatgcccagagctctcgagaatgaactcaaggaagttacagcgctatccctcgatttcacactttctcccgagacacctgctttacctgcagacatgctggagtttgatgagacttctagacgcatcgttgcattttgcttccgaaagaggcgtgacagggtcttgccgaagaattttgtggaagagcttgagctgagaaaaatcaagagagcgagaaaggatgccgaggagtcggagaagagacccgttgaagaagctgctgataagaaaaagcagcaggaggctgagaaacagacttctggtctacaaaacgcggaggaggaaaagatgccacttgctgaagagcctgctgagaggccggctggagagaaacgacgattaacagcagaagccgagaaacaagggctggctgaagcagaagctgagaaattgacggttactggagttggacgcgtcagacagactgaggaaactgagaaacagatactggtcggcgaggaagctggaagattgcgacaagctgaggaggaggagattcagggattgggtgaggaggaagtggaggtggagagggcgaagccggctactgaggctaaagatgctgctgaagatgagagccaaagacttgcagaagagtgtgaagaggtcgggcgtcatagacagacagaggagggggagcgactcagactgacaaaagaggagagaacgaagcatgctgacgaggaagagagggccaaacaggccgatcaggttatggaggctatggcatctttcacggccgaaaagaaaagacttgccgaggaggccgaacgagaaagactagccgataaggcggccgaggagcagaggttggcgatagaagcggtagacatggaaagggctgaggcagaggaacagagccggcaggaggtggccattttggactcaccagacgacagcgaatcttcccaggagatacaggttgagaagactgctgctgaggaagtggccgagaatctcagggtccaagaggaatggagacgacaagaggctgaaagacagaaggagattgaggccatcctagcggctgaaagaaaggagaaggctgctaaggaagctgaggttgaggccgagaccaaagctaatgcaaatattgaggctgaagctgctgacaccactcttaccgaagaacgccaagcagatttggaggatgaagaggatctgccccctactaataaccccattacagcattcctcagaactgtcaagctggctctgaatcgagcaccaccacctaggaaatagaagctatcaaacggcttggaaatatatatacatcaataatttataatttaatattcaatggcagctacaggatatcccactggtaagtcttatcggtatgtgtttagtaagttttcatgatatgtaaggggggttggcatctttggggtctactaagtagcagggaaactgacatgggactgtttagaagaatgaaatcataattttactaccaaaatatgttattattcccgcacttatttccaaatatctctatcatcacattctggagctttccatctgattctgacgacttcttcctcctgcaccctaaaaattcgtcggcataatgcatgcatcaacgatgcacattttttcgccactgaccaacctctccgaacctaaaccgcctcggcaagggatatataaaccccctctacgtcccactttttcaatcagaatcagaccagttcactctgagtcattctggagatggaaggtgcattttatagcctgctgagatgcagagctgataagcagacctgtctcatacaacgaggaccgcttcgctagccatgtccgttgaattgtttgggcaatgacgcgtttaccgcatgagcccttttcggtcaagagactctcgctatgacgcattgaaaaagatgtatgagcctgagaatgtgcgacagcttctgattgggcgtttgagctgagatttggttctcggcgagttcaacacagaggcgagtacgaccgcctgcgccaagtgtcagtaagtccgtgactgtgcgtccggttgaccgccatgagctgaaaatgccatgagccaagagcgagtttggcctgctgaaatgcctgagcctactccgtgtcttgtgagttcttgaggaccacatgtgcagccgccagagcaaagagccagacagtgaaacatctgcagagccaccgacagagattctcaagggtgaaactcctttcgagactcctttcccacaggtgaaattcctgtttactcacagggtgaaactcctttgtgaagtctcatagggtgaaattcctgtatgagaagccgcctagaatctgaagagccaagctgaaatgccagagctgccagttgtagagcaaagatctgctttgacagacgccatacatggtcaaaagagcaagccagagacagagctataagccagagccagtgcgacatgagccagagctgatacgccagataccacagagtcagagcgatagccagagcgacagatgcctgagtgtgagccataagtccaagagcaagagccacacaggtcagagccagcgctgaaatgccagagccagaacccatgacacgagcaaagagccagtaagcccttcaaggcaataagtgccaaacgccgtgagagcaacgtcaatgccactaagtccagagagcaataagagccatttcgcctgagcaagagccagtgagtccacagatgcaataagcgccaaacgccagagcacagacagagccgaaggagccagggccatagagccgaggccagccagttgccaataagtccaaagagcaatgagagcctgagcacgagccgaagtcacactattcaaggagtaggcagtgaacctcttagccagaggatgtaactgaccgaacctgtttatctagtttttaagaggagtaggtgaaaatccgaacctcttgggttaataaatcatggaccaaagagtccccccgaatatttgagttgtagagagttgaacagtatttgtagttgtagaagcgatcttttgtagagaaccattgctgaaccgccttgatctcgtgattattcaccttgttggagttggagaatggtgttatagccagtacacagttgcacgtacacagcggagaggccaagtattagtaacgttgaggaaacttagcctcgacaaatatccgtgactccctttggcagagaacaggtgagcagactgatcccacggaagacttcctgtgctatgggaatgctcttatgggcttcgagcacgacaccattggcctcacgttcatatatcccccttagaagacccctgtgacgctctcaacatgtcaatcaagacggcacaatatcgctaatcaggggggggggatacttattgtgccaggtgccacctccttcagaggtcatgaaacggctggaaatgatggtgatagaccaagatatacaattcgttggagagacgcccacttcgtgtactcttcgtcttgcgatcacggtcagtgcagtctcagcagtcagctccgactccacaggttttgtcggtccctctaaatttcacggtagatccgagtcctccgaatcgactgactcctgttctcctggctccgacatggactgtgaagagtagttctagcctgacggacttcgtaggtttgccatcagcacctctcttttccgcaggtacatctggtgcagtcatttgccgaaatctcgtcttaggtcgtatctgtttcatggctcctttgatgagctgtacccgttccaaatcaggcaaataagtaatcatcgaagttatacgtgacttctaaaaactaccgactatcttgtagatgacgtcgcaatactgaagctagatgggttgactactctgtgcttcaacaccaattcttccacttatacattgatgaagcccccgtaaaccacgaagtagagtcagttgaactcttcatgccatatggaatacgctcttacgaccatcttgagaaccactagagcacgcctgaaatgtcttgatatctgttataatcttatattgaagcaaggtcgttgaaagcatcccctttattatctgcacctcctaacagcttggttgaatggaggtgggggaccggtggaggaattaatgtacacgagtcgcagccctcgattcattcggttagtatacaagtagaagtgctttattttaacaatcggatgggttcactacaatctgttcatcatgaagtaccaaccccacagtcaccaaccaggaaccgttcaacattctgactgtgacccattacaccaggatgtcaacaggaaaaggatgttatcgattaataaccccttaaaattcgcacagagcctttagaaaagcctttgtactcccattacttcatattctcgctgtgagatcaatacattctcgatgttcattggtgagtccgccatcctcggcaatctctggtggaggctattgcggtgatattgcgcctgtccaagtccttgtttatcaagaatctgacatttccggatcaccaggtcgtccagacttgactctagatatgtactcatacaaggcaggttcactctgcctcgattactgctgcaccttcccgatctgttccacggtgtctaaaccagtagcattgaccatcatgccacagtaaacgaagctcgattcatcgcaatcatccaatggcctaatacacctaccgccagattccagagaatcaggtgatactgtgggccgcctcgtatacacagggcagaatgagtcatgaaaagcgtcgacgggcgcgatggaaaggcccaactttaaaccattattcatcgcgcgtcagtagtcgatccccatacgtcaggttgacagatgtctggtggagttgaaacatgtcaaacgtcattgtaagttttagcacctggcggtattttgtttgcgtctggcttgctctcgccccagtggatcgtgtatgccagacatcctcgccaaacatcgttgcttattgcctcaacacatgagaattctaacatatatgggctcaggcaacctcctgccagattttaccgaggaatatccttccagaagaccctatcatcaatcatggcggcataaagcctctggattgtactgtctaacctcgctgtagaagactcgacgagctatgacaaatgttattttcggtgactaaagagcaatgaagatcagcaggtctttatcggacgaggtggtggctatgccgtcggcaacccatcggagtaccgctcaacactgtcaccgagagaaatggctgaacgaagaggttggtgctgggcgagaacaagaagcagttggatcaccgtagttgccggttcagcttggactggatggctcactgcggaggaggatagatattctaccttcgtgtgcattgcctaagagcaagccgtcacatccgtcccataatagtgtataaagtcaagaaggatgtgagagcatctgacgctgtccacaagatcaagggggataagttccatagagatgagtaggaagccaatttctattgcaaaatgtacatgagccgtcagagaatagcaaaagccgacatatgcattcgctatatagtagaaactcaagcctttcgcttactttcgtaaaagtgtcaatgtccaacattccaaggtgtctaaactgagtcctgcagttcattgtcagtcatttgaatgctttgacaagacagttgctgaaataaagctgaagtccccttttctgttgtgtcatgaggaagagttcgtccaagcagggcagcccttcaagccagatatactgcttcctgaccaaccagagtcaagaaaaatgagcgagggggggtcaaaggacagttccaggagctcgggataagtttgaatggtaacccaaggcgtctattatgttttcatgactgaatgtatctcttcatgctgtgatctgtcgttatcgataaagaaagttcgaatgtgacgtcttagaccttgtcgtggggtgtgaaacttgttgacagtgttataccatgcctaccatggtgtctagaccattttaattgtagtcatagccttgctctgaggtcttggaaggtgttttattcactttacagtttcagggctgagctaaattcatacgataagatcactttaccgtttctcatgttgaagtaatggaggtgtgacttgagatatggatcttgaaccaattcaaaagtcttacttccactgccaattcaaagtcaaaaggcctcggctgttgtattattgaataccacgattaatatcttgtccctatcgtgtttcctcagtcaatattgatgagggagttgagaagagagaagagtaatggtgaaggcgttgctagggaatagaccactggagaaccagcacagaacgctcatgtgactcttgaactggcgattgacgtctaagttgatttaattgtgatatgattcattttcataccacctcgcattctgagaagtattgggaaagatgcgaaaagataatggagcggtatactgaccccgggatggatattaaactgttctctctgaaatacaaccactctaccgctttactgatgtgtctgatgatttatactgctatatcaaacaagggattgcttccattccattatcagatgtccatttgccctgtttacactataccaacattgtcctagaagcatcacatgattgcactcgatatatgtaaagaatttagctggtgcattttatataatcattcattcatgttagtctcacaaaatcccaagtaacagcccactaatgtaatggcgcctacctgcagaaggacggagaatcctgggcactaccatggtcgaagaacggcaaccagatccatggtacacggccatgacttgtacacgtatgtgttctatcctgccacgatcccataaaacaggtgcctaaaacatcatatggagaagttccatcatcccaagggttgtcacctcgaatagagacggtactagaaaatggtaaagcagaacagcggcagtggtgaaaaagcttcagtctgacactcgacggggacagcatatagaccgaggttttctgggttgtcaggtgataccagggctattcacaggggctaccacgtgggtaactcgttgactgcctgaataagcatagcgacggtctacaggtagccgacagtagatagccaggtgattttcctgagaaccagctgatggaagaccatgcctcggaccgagactttgagggagccgcgatggagatccgtgcccgacgtataaatgaatggggagtgtaatgagcggaggactgtaactcgtctcgaacttccgaatggggagagtcatgcccttggtgaatcctgaattggaccggaaggactaaatcttcaccaacttccgaatggggagatccatgccgagccctaacctgtgcctatcacttgcgaatggggagaacgttgccctgacgattctctgacaagggattgtctcgcgcgacctcgaggggacggactaatggtagtaagaatgggggtggttgtaccgcagtatgatcatctctatctcactaagattagtctgagtggggatcctgccgagtggtgggaccatcttgtcttgacgacacaaggtggtagggagtccatgggggagggtcagagacccagctcaggtgggccaaggcctaccagggttggagtgctggccattggcacccttgatgggtggtctcgagaagagaagagcttagtaatgtttttgttattttttcgccaagttttccccggcgaggttgcgggggctgggtgagagagagggatgagagagatagatgggataaaagagggaaaaaagagataaatggagagaagttggaggtgaaaaacgtggcgtgcatggataatgcgggttaaagttgtggctgtgctagagtaggagggagtaaaaatgtcaaagtagtgtgtttagtcagcatttcccaagccgattgatggtatattctgaagtaaacggtgagaatacgggtaggcctaagtaagaaaggcccaaggaataaggaattgcttagcaacactcacaaacaatatatatgggtagagatttgaaggtgtttatatagtggcgcattaactttgacacggcgatgaagtccatatcaaaacaagacttggaaaatcatgtgaggaacaatataaggcctttgattggttcccctttacgtccatgaccgcgaaaagttgccaatctggttcaaatcgctttactctactacattccattgtcttgctatacgatcgtatatggagagatacgaaagtctaatccatggtagaagagtgagtatagcaacagaatagagcagtagaatgacagatggatagtattggggttaatggaatgattctggtctcagggataccctaaccctgttctattaatagaaaatggatcgtttatgcgttcttgagctcgacagacggtaaggggtacatgcatggtttgaagttaatggagatggagtaagatgagagggaagagatgatgaacttgatcgatgaggaaacaccaggagttgtgattatacactgacattgaaatagtctgtggagattcgaatgcctacaagagagatggggatgtctatgatctttccattcacatgccagtcgggtgagtatgcgttttcattattccctatcaagtgttctctgatacacacgtgcttgaatttacggggttatctcctatcaattgtgctctgatatagacatccgctcggatggtaactcacatactgcttcggcatatggacgttgacgcggtacatctgctcaggaatcagctcaatactaaagtccaatactaagtcgcctaccatggatttactcccactcctagttcacatggtgtttgctgctgtctgaccaggcaatgcagcgaagcaccacccgctgggttatggccgaacgcctccaagtcagaacccatgccagaagggaagaatcagggggaaggagggatatgaagaagtaccgcagtaccggagggggagggggggtggataaggaaaccgcccgcccccccccgactggaaagacccacccttgtgaaatccattgtagacgactttagtatgcgacgaggtattgtaagtagtagagtagccttgttgttacgatctattgagattaagcctttgttgtttagattcgaggcgaggcgcgtactttacgaggcgcgtagacagcgtagctgttgaagtgccgagcaacatgatgaggcacgtagacagcgtagctgttgtagtgccgagcatacttttcgaggcgcgtgcttgacgaggcacttgacgaggcacttgacgaggcgcgtgcttgacgaggcacttgacgaggcacttgacgaggcgcgtgcttgacgaggcacttgacgaggcgcgtgcttgacgaggcacttgacgaggcgcgtgcttgacgaggcacttgacgaggcgcgtgcttgacgaggcacttgacgaggctcgtagacagcgtgaccgtaaaagtgccgagtggtgaaggaacagccgtcacagacgctcacagtcaagtctgaccacgtcacgtaggattccaagtcctgactaaggaccatgtgctgacgtttgcagaacatggtatgtgtcgaagatctgattattttgttcttgagtgttcaagatcttaaagagttgaaaagacgatagtgcctgtgattgaggttgttgtgttgtttcaacggagttgaatttgcggggggatgtttttcacgtaatggagggcctgacggggttcatccggaggtctgacgtctagaggtaaatgttgtggtgtctgtccttgtagacaggttggagactgtccggacgtctagaggtaaatgttctggtgtctgtccttgtagacaggttggagactgtccgatacatcctttgttgtgattagtgtttcagctgtgagtctgcgctgtttgtgtccttgtagacaggttggagaccatcacatgtcttttgttgggacttgtaaacatttgtttgtgttcacgtttgaggggccgtctgtgtccttgtagacaggttggagaccaaagaggtccttgttgggactagtagaccttgccttgtgttcaagagtcgattagtaaacgtctgaggtgcagtctgtgtccgtccagactggttggagaccatcagattgttgtttgttgtgactttgtgtttcaaaccggtggattgtgacattgtgacgacggtgccggacttgtagaggcaggtttgaatgtttctggttgtctgtgtccttgtagacaggtggagaccgtcagatcgttgttgtgactagttgacatttgtttgtgttcacgtttgaggtgtgtctgtgtccttcttaacagcttggataccatcagattgttgtttgttgtgactttgtgtttcaaaccggtggattgtgtcattgtgacggtgccggacttgtagagtcaggtctaaacgtctctgcttgcctctgtggtgctttctgtgtccttctagactggttggagaccatcacatgtcttttgttgtgactagtcgacatttgtttgtgttcacgtttgaagtgcgtctgtgtccttgtagactggttcgaaaccatcagatgagttgtttgttgtgactttgtttcaaaccggtggattgtttcgttgtgacggtcccggacttgtcccggagggtgttctagagtcagctgtaagtcagcgcttgcttctgtggtgctgtctgtttcttctgaccagttggagaccatcagagatgatctttattgtgactttgtgtttcaaactggtggattgcttccttgtgatggaccggacttgtcccggagggtgttctagagtcagctgtgagtctgcgcttgcttctgtgctgtttgtgaccttctagactggttggagaccatcagatacatccttgttgtgacttagtgtttctacccggtggattgtctccttgtgatggactggacttgttccgaagggtgttcgagagtcagctgtgagtctgcgcttgcttctgtggtgctgtctgtttcttccgactggttggataccatcagatgagttgtttgttggacttgttgtgtacacgtttgaagtgtgtctgtgtccttgtagagtcagctgtgagtctgcacttgcttctgtggtgtttgtgtccgtccagactggttggagaccatcaggtcgttgtttgttgtgactttgtgtttcaaaccggtggattgtgtcattgtgatggaccggacttgtcccggagggtgttctagagtcagctgtgagtcagcgcttgcttctgtggtgctgtctgtttcttccgaccggttggggtccaacaaagatgctctttaatgtgaattaatgtttcaaccttaaaccatgtttccttaaggcggccccggccttgtctcggtgggtgttctcgcgtcacagtctgttgtgccatctgtttccctctggttggcgtccctccgttcgttgtttgttgggtcttaccgttgccttgtgttctcatggggttggtcatctccttctgacctgctgtctgtttccctctcacgtggttggcgcccctcagctgtgttgtttgagatgagttgtttgttgggcctcatgttcgaaacgcctcatcaacgtccgaggtgaatctgactggttggcaaccaacaaaaatgctctttaatgtgaattagtgtttcaaacgaagccatgtttctttgtggcggtcccggcattgtcccggcagtgttcgaaaatcaactgtcaatctgcgcttgcttctgtggtgctgtctgtttcttctgaccggttggcacacaacaataaagctctttaatgtgaatttgtgtttcaacctgatgccatgtttccttgtggcggtcccggtattgtcccggtgccatctgtttctcaatggttgggacaccacaactaactgtttcaacttgttccaaaaaaagcgccaaaatcaactcacaagcctgacaaacaatccgatcgatttcactcggtcgtacaacccccattgccaactatccaatcatatcatcaatgataatgaattccgccaatttccaatttacgttactcaaatccaccaatcgtggggagttgggaagtggagttggcaatttcacagaagcaaaaaagcagtacacaaaaacttgtcaggggctaaccaagtttaacttgtaacaggccaggggcggttgatggggtaatcggcttgtcaatgggtacaccggttcccaacgaatttcattagttcacaatttctgcgtcgtttttgtgcttagcctctttccgtgttgtctgggcctggtttttagccggtttttccgggctccttttgcaccaatgtttccccaagttgggtggttttggggggtagggctgctgacttacggggcacaggggtgttgtgctagatctcccccctacatatagtagggggggggggggaagaaaaaataattaattagaatttaattgtaatcaaaaaataaattaaatgatatgaagtcattttttaaggtggtagagttgattcatgacctacaaattacattaaggaaggttattattatactaactattcaattgaattgagatagtattaatacctaaagggaaacctaaataagaaaaatagtgaattgaaacatcttagtagctataaaaagaaaataacaatgatttatagagtagtggtgaacgaaatataaaaagttcaatgagtaatacatagaaagtgtatgaatataactgcataaacagttaagactaaaaacttaatgtaaataacataagtactgtgaaggaaatatggataatggatcaatatagctaataatattcgaataagaatattatgtacctattgcataatgggttggttagttattagatatagcaaatcaaataagaagatatatataactaaaaataaataagttatatttaatatacccgaaactagatgattttttcttgaccaagtaattcattaatttgaattgactgaacggtaatttgtagcaataaattccgatgagttgagaaagggaagtgaaagacaaatctgatttagatatagctggttgtcgacgaaatatatattagtatagaccatttaaagttttatatatataaaacaaaatattactataatattacagcaatttttattgacataatcattttttatatataaaaaatggtaataatattggggatcctaaacgatttatcaacaataaataacctcgaaatatgatatgtaattcataaatggattcggactatttactttaaggtaattagtcaatagggcaataacccgaataaatgataaagtaccaaaataatattaagtgttatcaacataaatttgtattaatacgttttaattactgggtttgatagtaactatgttttaattaacgtgtaacaacgaattaaataataaatacagtttgtgataaattattagtgctcaaaatattatactgattcatttaatatttacatctcgcaatccgcgagatagtaaataagatagtcgactacataatgagagttaaacctatagaaataaaatattaatgtttataggttattgaattatgttaaaactgctaacatgagtaacgtaaattggtaaagtttataaaacaaaaaccaattcatcttaaaagcgaggttttaatagaaaatacggattctaagcaaataattttgacaaaaattaggcgatgaaaatttaaattgtacagttataataatatatatattatattatattagactcaagaaatataatttataaataccgtaattataccgacacaggtgcttatatagagaatattaagatgaacgagtgtaatgaatattaaggaactcggcaaaaaaaatgatagataattcatataaaaatgaagttgtacaactgtttaactaaaacacagcacattgcagatattaaattattagtataatgtgtgaactctgctcaatgcttagaaataaatgaattgattaattttgtgattgattttcaatacttgcaaatagccttaacgtgagggttctaaggtagcgaaattcctaggctaataattgtagtcctgcatgaatgacgtaatgatacaacaactgtctctatattcaactcggtgaaattaaatatgtcgtgaatattcgacatgaaacatgtaattagacgaaaagacttaggcagctttactataacatattattgttaataatgagatgattttattatacatattcgggaaatagaagattatatctccggctctttcgagcaggttatataatattattaataatattaataatattaatattattaataatgtatttattatttaatttattaaataataaattataatatatatatttatattaaattattcaataattagataaatatatactcattattgtattaataattataaatagcaagtaattaaattatgtatataattataatttggaagaattactttaattattaataaagacttattttactttttaatttaaagatttaaattaggtagaagaacgtgatatgtggttagttttactggggcggtattttcataaaaactatctgaaaattccataatgataataattttaattaaaattagttataattaatatatgatcaaattagtaaagaaaactaaattcattaaataaggatgaataaaatcaataataggataatcatatatgatttaagtttcaacaaaaatttaaaggatgaaaatctggtatagtgaacagaacattatattgaatttatagagtgttcgattaaaggataaaagttacgccttagataactggttaatttggataatagttctaatcgtaatccaagcttaacacctcgatgtcggcttacgttatcctagaagtgaagcagcttctaaaggttaaactgttcgtatattaaaaacgtacatgagctgggttcagtgcattgtgagatagcacggtttctatcttttacatggtaaatgtttctatttaattggtttacttagtacgacaggattggtaaacaattatcactggttaattattaagtatatttatataaatataacgtgattaagctacataattaaataataaaaattgaaagaatataaaatttgaagtataattagttaggcataaaatatatattgtagattacaatatcgtatatatattcatatatactatcgactagaatatagtcagatttaatatacaccttaataaatacatatcttagtctccctataataaataaaaataaaaaatattcctattaacccttctaacccttccaaagaattaataatgaataggtaatgcaaaggttaaccctcaaaatcatttattttgagaatggtttatatatatataaaattatagggaaagagttaagggtaaatgttaaattagtttaagggtaaaacaattgttttgtaatcagtagcttttggttcaaatccaaaatttaacattaaaatttataatattatcctcccataattaaaagagttgatttttaagaccttatcgtcaaacgtaagacgttagaacttcactctaaaaatacgggttcaagtcccgttaaggttaaaaaatataatattattaaagtaacatagtgtaatggtatcacatcaggctcataatctgataatatttggttcgaatccatttgttgctatataatttataataggttaatagaaagtttggaactatagtttaaaggttaaaactaaccgctcataacggttcaatgattgttcgagtcaatctggttctataaaaatatataaatatattttttatatttattaaataataagtcaaaatgatggaattggtagacatgatccgcttaagttggattgcttttttgcatataggttcgagtcctatttttgatatagaagggagtaataatacttcctttaaaagtagaatatatatataacataataacaaaaagtagactctgaaccatctctttgagacggttcgagtcctatttttgttatagaagggaataaatatatacacataaaagaataatatataagaaaaaaaaataacgaatgtccctaacttcatccttttggattgtaagttccgataaatatatatattatatgttcataaattaagatatatatatatctattatcggtccttctctttgataatttattaataatgtgttaggtagcgggcagggtatttaatacttttagctctactgagttgtagattaattggcaaatcacttaaatttgagttaagactatgaaagttcgaatctttccaattcatattaaatatattaattaagggtttatagtttaacggtaaaacttttgtcttttaatcaataaatataggttcgattcctattggacccctttctattatttatattaaataatataattattatataaaggaccaaatagaatcgaactatcggcttgccgaaggttcgattcctataggacccctttctattatttatattaaataatataattatttatgaaatattcaatagataattataaaaatttaaggtactttttaactaattgaatcgaaacatcttagtttgtaaagctatatataattatatataggtaaaagttgtatatgtaaaaaatttaagttaaaaatagtaaaaacctttaatttaacggtaaaatacataattgataattatgatacgtcaggttcgactcctacaaggtttaataaaggatatttggctgagcggttgaaagcatgatatttgagctatcatatataatttattatatcgagagttcgaatctctcagtatccgaatatttttttatcagccctaacttataatctactatatgtaggtaaatagtgggcagataattaattataacatatgtcatattatattgacttaaggggattttaatttaactggtaaaataatagttttgcatactataaatatgagttcgattctcatagattccataataatagttcgcataacttaaatggttagagtgacaatttgaagcattgtatgtctaggttcaattcctggtgtggacattaataatatatatataatatagataaagtcatatttataataaatatttattcaatacagcaaattaaaaattaagtataataaatatattatttattaattatcagctggcctccctaccccctactagtagggggtagggaggctataataaatttaataaatttatgtgcagataataaagggtgatactttcaaaagaccttgcttaaatataagattatatagtattataggaaagatctccaatgttggtatttggagttgagctgtagtctcaatgattaacttcttcgtaggttcaattcctactcttttcatagaaaggtattaaattatatgagatgcatatctaaatacccaagagttagaattgaactatttcacagggaggagtgactatagtcactcctaactgaaagaaaaggttcaattcctactcttttcatctcctccctttcccttataatataaaagataagcgacaagattcattcgattagccgttggaacttgaaccatctcttaccctcctttttttatataaaaaaggagggaactaaaagagaaggttcaattcctactcttttcatagaaaggtattaaattatatgagatacatatctaaatacccaagagttagaattgaactatataactaacccatctttgatgggttagttaaagaaaaagattaaattccaactttttagttattatagcttaaaggtaaagccgatcactgttaatgatctgatgtaggttcgattccttctgataacgtataaaatttagaataaaatctataaaacttatccttaaattgaggaaataaaaaacaaaacaaaatgatgtacttaacatattactttattgaaataactattttcttagctattttatgtactatatttataatatcagctaaaaatcctatggttagtatattatatatgattgctttattcgttatagcagctatgtatttatacttaattggtttaggtatatttagtttattatatataatgatatatataggagctatagcagttctattcttatttattataactttattagatataaattctactgaattatcagtaaaatctaatataagagatttaccattagtattaatttcattaatagttttaactataagtggtttaatgatatattcaaatgatagtatattaattaataaattattagaagcctttggtaatgattataatactataataacacaagactggttcaatatagaaaatacaactttattaacaactataggaaatgtattattaacaaataatgcttttatcttattagtgttagctatagtattattattaggaattataggtcctatatcaataacaatgaaacataaagaataaatattctattatatagcattaaaataaatttaatgcagtccccccctaccccccccctactagtagggggtaggacagttttagccatctttgatggattgggggcagctagaatattggacccagattaattaattttaatttaaggtggtattcctctattctgttaatagaggagtcaacttgggtatcagaaataaaataaagtcatatctctaatacaattatggatagtagacaaaccataaaaaaaaatgataataaatatcgtagaaattttaatatttttagtttgtgtgttatttagtgttgcttacttaactgtagccgaaagaaagacattagcatatatgcaaagaagattaggtccaaactttgtgggttttaatgaagaaaattaaataataatattaattatgtttaagacaattgatacaaagccatcacagattatagaaaataaattatatcaaattgaaatatatattatatttaaatatagaaaatacctatgtattgtttttggaatgtaaaaatataatggatacattatatttatcagaaaacaatataaataaaagaatattttgaattatctattatagatatattttttaaaagaaaatattaaagagagaaaacttttgtaagtttttcctttattaaaaattaacttttatagtaaaaattctttagttaatacttaatttataaaatcaattaataatctgtccactatttacctatatataataggttatgagtaaaggttgaaaataaaataaatatggatataaatgatatataatattatatctataaatgaggcaaataaaaattatcaatgtcaaataaaaaaataaatataaaaaatctaaattaataaagatatctataggaatatatatttaattaataaattaattaattaatttatgttatgttatgttatgttatgttatgttatgttatgttatgttatgttatttaataaataaaagtcataaaaagaattaagaactttttttagtagcccaaatagaagtgaaccttctattaaatatcatcaaattgcggggaacccttaaagctatttcaactaaacaaagatggtaacatctttgtggtacaggtaatgactcgtaatatagtaaaatcgaaatagatgacgaaaggaaataggcaatctgcagccaagttccataataaatatggaatgcagttcatcgactaaatggtggtaggtatctgaaagatgatatttaaaatatagtcagtccctattcgaaagaataagaaataaatagtaataaataaatatgttcatttaatttatatatttataggggggtaaatctctaacttttcctttaaatatcagcccgctctcgggctgaggataaaagagattaacgtactatggacttcttcaagcattcgcagacgcggtaaaactattattaaaagaaatagttttaccaaaagaatcaaattatataattttagttattagtcctttaattactttaattacagccttaataggttgagtagttataccactaggtccaggtataactttaggtgaattaaatttaggtattttatttagtttagctataggatcattaggtgtatttggttcattattaagtggttgatcatctaatagtaaatattcattattaggttcaattagatcaacagctcaattaatatcatatgagttaatattaacatctattttcattataattataatgttcgttagttctttaaatattactactataattgaaacacaaagagttgtatgatattgtatcccattattacctctattattaatattctttatagcttcagttgcagaaacagctagacctccttttgatttaacagaatctgagtctgaattagttgctggttattttactgaatattcaggtagtccatttgtattcttcttcttagcagagtattcaaatattatcttaattagtgcttttaatggttatttattattaggtggttacttatcatttaactatagttacttattcaatatattatttaacgattatagttatgtttctttcttatttgaaggtttaattaattcatcagcttatgctatcaaattagtattcttaatgttctcatttatttgagttagagcagctttcccaagatttacttatgataatttaattaacttctgttgaataatattattacctttattatttggtatattcttaataataccatctacattatatatatttgatagtttccctacattaatataatatattataaattatggtctttatcttttccttatataaattaaggtagatatagtaatatatattacgttcgcaaattaatttgcgaacatgggatattgtatcggtatacaaatgggattgcaaatcttattatattagttcgactctaatatatcctttaaaaaaataaaagtcatagttttttgatatttccctcccctcctatagtttataaaggtaatataatagggagggtataaataatataataattagttatatattatatagttatattattatacattcatatattttaaagtataaaataaagataaagataatataaatatataataatattatatagttatattattatatatcatatattttaaagtataaaataaagataaagataatataaatatatgaggaggggtgaaaacaagaaaattaatttaattgtaatcaaaaaatatataataataatataatatatatttatattatgcttgatattattataatatacaagcaaatataggttaatggtagaccaaatgatttccaatcattatgtgctagttcgagtctagttatttgtatcaaataaaaaagacatagaaattagcttaattggtaaagcaactatcttacacatagaagagtataggttcgaatcctatatttctaatattcctctccattagaggtgcaatttatatagtataatcaattatacgaatagttagtcagaaatagcagatacgaactatcgaaggttcgaatgctatatatattctaatatattatataaacctaaggtgggtttataagacgtatatataaatatatataataaatatatagtaataattatataaataaatcataaaaataataataaaaaaagagttttatattggctctcgtaagtattatctagaaacatatattatgcaaactaacaaattatagattttcataagggaaatagtagtataatttagagtagtgaacacacgagtaatagataagaaactacaacataatatagcaataaatttgtaataagaatattataaaagaatttataatatttataaagtatgtataaacatatgtattatgtgaggcttatcttaatattaggtagttggttacaataaatagagaacgcaagcttaaaatatttagtctaattaagaccgtgtaggatctgaaacatatcctaatttcaatgaaatcagcagtaagtaacattcgtcaatgattgaaagattgaacgagttatctagtagaattattaaaactgaagttaaagatatggaaaaatagtaatgtattaaaaaatatcagtaatagttttagaacgaacataaaattcgaattttaatataaaaaagatatattaattgtgatagtatgtactaatatcagtgccagcagtagcggtaatactgatcatacaaatacttataatatacttggcttaaagggtttgtagatggatgtaacaatacatactagaatttataagatgttatttcaattttaaaagtaaggataaaatttgcgtataattaaagttgacccaaaatttggaaaataataacaaatatgaattgacattaagaaacgaaagttaaaatatagaaatcgattagagaccggtgtatttttaaccgtaaacgaaacatattgagaataaaaatagttaaacgataatatgtcgccatagtagtacgttcccaggaataaaactaaaaatataagacggtttggaactcaagtagtggaacatgttgtttaattcgataatccccgataaacttacctatttttgtattctaaacaggtgttacatcattgtcttcaattcgtgttgtgaaatgttaggttaagtccaagcaacgaataaaaacctctataatattaataaatattatttatatttaatcaaaatggttaacataaagaggactaagacaaatcaagatgacccaaatagatagggctacagatgtgttacaaaatataaagaaataaaaaattaaagaaataataaaaactttaataaaatatataaattatataataaaatgattatttcatttgctccatggataaaagtttgaaattcagctttttgaaaaaggaattactagtaattatcgttaagtatacgataatgaatatcatctttcattcgtactaatcactcatcacttgcttaaagaataaaatgttaagtttttttaaagtaaatcaaattaaatttgtttttatattattattacagccccctaattcatattttgaataggtaagaggtaataataataattgttatatatttattaaaatatataataatattaaatacgcattaagtttaataagtaagaagttgaaatacagttactgtagaggaatctgcagtggtaaataaaaatttaagaagaatctttttaaatatatataagatgttcatagtttaatggtaaaacatagacttgtggtgtctaatttttgagttcgattctcaatttacatccaataatatataataacaaatacaaatataaatataaaaatatttggatcaattaataataataaaaatgacatatataaataagcaaaatagtaattataaaataaataattttaattatttaactaaaaataatttaaaacaaaatgatgttataaataatatagataaaattatagatacatatatggtaaaatttataaataatgatataaaagatgataataaattaaaattaaataataataataatattgttttaaaagaaagaactattaattttaataaaagaaatactttatataatactaattataacttagagaataataatatagagataataatgtttatatatgaaaaatcagcaaaaaataaattattatatagttacttaactaatttaagattaaaaagaagattcttcaaaaagaaaaatagaaaaacagacatatctttagatttattaattaaacataatcaaaaatcattatattatataaattcatcatcaaatatgaatattaataattctacttattctaatttagaggattatttaaataatatatatatagattataatataacaataaaacctataatattaaaatatcctcagatggataataaaatatttaataattttatattgtttagacaaactaaaaaaacaaatataatatgaagatattataaaagattatttaaaaaaatgaaagtagttaatcataaaaatataggtaatatagctatctctaatttaaaaagaatagatagaaatattaataaaactaatgaagaattacctttaaatacaataaataaaaatagaaaaagtatattatcagattatttattatataaaagaatagtaggttttagtttaaattttacaggacaatatttaactaaaaaaaaaaaagaaaagtaaaaccttattcaataagcaaaggtcctttatataattcaatgtgttcttataataataattataatagtattacttttaataaatatccaggatatattagtgtatattcaaaatctactacttataataatacagtattaggaaaaataggtttaaatactaaaataacattagtataaaaaaaaaaagtatatatatatatatatatatatatatgaattaatagcttaatggtaaagcatacacttgtcacgtgtagaaatgtctgttcgactcagatttaattcgataaaataaaaaaagaacataaagaatgaccatccccccccccttaaaattttaataatatatgattagaggggggggttttgcaagtttaataaattataatttgtaattataatactatctggccccctcctaactaaatcaaacataagattagggtaaatagagataaaataataaaaatgtttatgtagtttaatggtaaaactttcgcttcttacgcgaactctggtagttcgattctacccataaacgatataagtagaaatgaaattttgttcgttttatacattgaaaactatacaaattaactaaaatatatatatataaattatatatattctatatataactataaagttaaatttctagataagtaaaacaaagctatatagaacttaaaatcacttgaatgttcgaagataaagtagatttaacataattattctaatcaaaaagatatatactatctcttaccataattcttttagggtaagaggtttatatataaatcatatatactttaggtaatctagggaaaatataaatatcaggccgcgttactcattataaatgggttagggctgaaagattaattatgagtttatatagtataagacttatcactcttaaatagagaagtctaaataatataatttataaatataaaagatattataaatcaattatgtatcctaaaattaatatattaaaattaataatattaataaaacccccccggccctctaacccattataaatgggggggggctgatataataaaaaaatcctctttctaatataaaatgttaggttaaaggttaataattatagtaataattaagggggggggataagggtaagacagagaaaaataaaaaaatatattcatcgtggggacacctatgaaaattattcattatgagtttaaaattaaatattcaaagatgattattttctacaaatgctaaggatatcgcggttctgtattttatttttgctttattttcagcaatgattggtacaggattatccgctataattagattagaattagctaacacaggatcaccgttcttacatggaaatactcaagcatttaatgtagtgatcacagctcatgcaatattaatgatattcttcttcgtcaacaatagaatattatttaaatctcatacaccaaataataatataattataaatcctgatagtgttataataagtgataataataataacaataataacaataataataataatcattttaaatatactaaagtaataatagaagatccattaaacaatagagatatattattaagggtagcaaaaggtcaaaaaggtatatatatttgggaaagtatagatggtaaaaataaatatgtaggacattctataaatttatataatagaatatcatcatattatatgccaagtatcttaaaaactaaagctagaaaagtattatcatatttaaatgaaaatggttttaaagatattaaattaactatatatattttaaattcagaaatattaatagatgatttagtaaaattagaacaacatttctttgatacattaaaaccaaatttaaatatgactttaatagctagtgctacttataataatggtactatgagtgaaaatgctaaatcaaaattaagaactgaaagaggtatacctatctttatatatgatgtaaatactttaaatttattatatatatttgaatctaaacaagatatgtataataaattacatatacatcatattactttaaataaatgtttagacttaagtgaattttatttagataattttttattatcattagattatatagaagaatttataaatgaagatatattatctttagatgaaattataaatttaataactaaaagtagagaaatatataaaataacaagacaacctaaatctaaaaagatattagcagaatttaaaggtaatcctgataataataaagtatttacatcattaaatgaattagctaaatatttaaaaggagatagagctactattagaaaatatttaaaaggagaaggttattatagaggagtatgaagatttaaatactggcaaggcgagataaaatagaaatattttagtctagatttcaccatatgctggaatccctttagagcttttaaaactagtattgcagacttaattaattaataaagcggcaataaacagtaacaatttaaaaagattaggcaaatcagcaggaaaccaaagattaatggacattaataaatataaatataaatataaatataaatataaatataaatattaatgtataaaacacgttaatttagtaggttcctcagagactacacgtgaaatacctgactaaacatataatatatatgtttaaaggtaaagatatagtccatacataaatgaaagtttatggtcatatgcatgccagctttagtaggaggttttggtaaaataaggtttaaatcagtaataaatttaactgaaaaaaatacaatagactcagaattaaataacaaactaaatgaaaatcaaattaattataataatttaggtccatatttaactggtttaattgaaggaaatggtacaatatcagtatcaaaaaaagaattaggaaaatataaatataaaccaagtataagtatagtatttaataaaaaagataaaccattatgtaaatatttaataaatttaactaaatgtggaataattaataaagaaaaaggtaattattttatatgacaaataaataaattaagtgaattttatattattttatctttaactaatggttattatagaacacctaaatatgaaggatatttaagggctatagagtttaataatgattatattaataaaaatataaatcatacacatcctaatactataaatattataaataatataaagataattaaagctttaccattagatagttcaaatattgaatcaaattcttgattagcaggatttacagatgctgatggaaatttttccttagctatagattctggtagattaagaataaacccagcttatagattagaaataagacaaaattataataattatgtcgatactcaaaataaaggattatatcctagagattattttgaaataatgtcaaaaataggagcttatttagaagtaaatttatatactagaagtagaaatatgaatatagataaagaaataaaaacatatcattcatatattataatgactaatagtataataaaaaatactaatgttataaaatattttgataaatttccattattatctagtaagttcttagattattctaattgaaaatatatggatcaatatataaaaattaatgggcaatgtaaaaatacttgagatttaggtctaaaattaaaaaaagattataattcaactagaacaacttttacatgaaaacatttagttaatagttatttagaacattaaaaactattgtattaaattaaacataattgccgttataaactgtaaagtttataataattacaacactatatgcgggaaacccctaaagatatatttaaaacaatattgaaagttttatgacttatatataaaaaatatatatttaataaaatgtaaaatatatttcaagataatatatatatatatataaatatttaattaaagatatttatataaaaatgggcaatccgcaggaaacgatgtataatatagattttattatatttaggttcctcagagactacacgtgttgcaccaatcttaagattggttgaagatatagtccaaatgttatacgaaagataacaataaaaagaattacttaatgccattaatgttaggagctagtgatatggctttcgctagattaaacaatatctcattctgattattagtaccttcattaatattaatattaacttcagctttagttgaagctggtgctggtacaggatgaactgtaaaaaaaatatgcagttctaaaatgccattcgatgcatgaaacacctttataattattattataaaatgtttaaattactcaattgtcttacttatatgttatactatatacggatataattatatatcatatataggtattaaatgatataaatcatttatgagtcaattagttaaaatatttaaacatataggtcaatatgcctgtatattaactaatatacatcagagactacacatggcaaaacaatattcaaatatgtcaaattctaataataatcctaaagatccattcaattttgaagaatgattagtaggattagtagatggtgatggtacttttaatgtatatgtatatcctgataaaaataaaggtacatttacatttaaaatatcattatctaaatataatgctcaaatgttatattatataaaaactaaattaggtgttggtagtgtaactattacatctaataatagtttagataaaaatatgataacttttagaattagaaatactaaacatctaaaagatattatattccctatttttgataaatatcctttattaacaataaaaagatataaatatcttatatttaaagaatgtgtattattatctttaaattcgactttaacacaagaagaaaaatatagacaaataagacaaatatataaaaataaacaatcagaagattatatatcagatgcttgaaaaggtttaactatagaagatcttaataaagataaaacattagttaaaaatatcatgtctaaagcatgattagcaggatttatagatgctgaaggttgttttacttatgttaaaaaagattcaactaggaattacacattgttttgctattactcaaaaatatgatcaaatagtattatatggtataaaatatttattaaaaataaatgcaaatgtaatatgaaacaaaaaaggtttctattcattaaatacaactaattctagaaatgttgaatatattatagatttctttacatacaatgattatttttcattatttaaaggagtaaaaagctttgaatttacaatatgaagaagaagttataataaacataaaggggattataaaaaattagagcaaataagtatttgaataaatactattagaaataaacataaatattaatattgtttaaggtatagtccgaacaattatgtaaataattgatataatatgagcatatatatatatatatgtgtaattataaacaaattagatatttcccattagcaggtatccaatcacatagtggtccagctgtagatttagctatcttcagtttacatttatcaggattctcatcattattaggagctatcaacttcataacaactttcattaacatgagaacaattggaatgaaatatgagaatgttccattattcgcttgagcagtattatttacagctatcttattattattaagtttacctgtattagctgctggattaacaatgggaatcttcgatagaaactttaatacttcattcttcgagtatgcaggtggtggtgatgctgtattataccaacacctattctattgatgaaataaaataatattaataagtttagttttttatattaaaaacaataaagataacatagatgaattagaattaaatgataaggatattatagatataccagatgaaataataaataatgaaaataataaaaataatataaaaaactttaattataaagatttttataaagcatttgaaaaaatatatccaaataaagaaaaaccttctaaagatttcttaaattgatttataggtttttttgaaggggatggttctataataaattttagtagagccaattcatttggtttagttataactcaacatagagataatgtagatgtattacattatattaaagataatctaggttatggtattataactaaacaaggtaaatatatagatagatatatagtacaaggtattgatgattattatttaatgcttttaatattaaatggtaatttaatattaccatatagaaagaaagtatttaaaactagtcttgataaattcaataaatgattaagtactggaaatagtactataagagtatcatatattgaatataaagattataatcttttacctaagttaaataaccattgaatatcaggttttacagatgctgaaggttgttttactatatctatgttattaagaaaaacaggtacttatagacatagaagttaaatttattttaagtcaaaaacatgcttataaatttacctatattaagtcattttttattattatttaaagtaggttatatagaacctcattcaaataaagataattaatcatatataagaacaggattgaaaaataataaattaatatatgattattttgataattataaattaataactaaaaaagattcatataataaatgaaaagctttaataaaaaaattagaggataaagaacatttattaaatcatgaaaaagctttagaattaaaatttgaaactaaacttattaatcctaaaaaaggaaatggaaaataaggattaatttatcgtaagatatgaaattctataagcaggtgtaaaattaaataagacttatacagaatgaacatataattaataaatgtattaattccttagtaatatatatatatattaattatatatattgcaatgcagtgaaaacggtcaattgaaaataataatagaaagaccgtcggtcatattagattatttaggtttatatctcagtagtttaataattagatcgctacagactggttcactgtgggtgtgtacataatgaataaaaattatgacatgcttaatgtacagtcggtacccatatattattaataatataatatttagttattatatgttatataattaacatatctaaatatatagggtatggattcttcggtcaatggtggccctttaactttaaagttaatgcataacactatatgctggaaagagaaaatgataattactagtaataagaataaaattacagtgataatattatctattatatataaattatataaatctaatcagcaggtaaccaaagatatattaatatcaagtaggaacctcagagactatacgtgttataaaaatatatatatatttttaaagatatagtcctatatattataaatatattatgaagatctcttaatatttttgaggatatttatataatatatatattataatattaatgcacccagaggtaaaaataatatgcctcataatattgctatatgctgggaagtcctttatatcaaagatatataatattaaaggcagtatcaatcatatatatattaataatgtaatagttttaatattatctaaattaaattattgtattaataataatataataatatatagaaaaggattatcagcaggtaactttataaataaaggaacctcagagactatacgcaataatatagatttaattatagaaatattattatataataaagtagttaaaactattaaagatatttctgttcatatacctaaacataatagaattaataatgataatgacttaggttattatttagcaggtttaatggattcaaatagtgaaataataaataataatatgataatacattttaataatgatgattatagttacatgtatttaattaaaaaacaaataggttatggttctattattaaaggtaataactgtaaattaataataaaatctaatggtatacctaaagtattaaatttgataaataataagataaataataaaatattatttacacaaataataaattatataaaattaaataatttaaatatagattttatattaaataataatttgaatatattaaataattattgattatcagggtatttagatgtaaattctaaatttgatataaatttaaatttaattaataataatttatataatattgattttaatttatatataaaagcacctttaaatgataaaaataatatagataataatatattaaatttaattaattctaatcttaaaggttatatatataaagatgaaaataataatgcaatatataatataaatagtttaaatatagtatataaatatataatgtatttaagaagttatcatttaatgtcaaataaatatttaacttatatatattgaagaaaaacatatattagagttcaaaatataatatgatatgttactaatggtatacctaaaatagattattataatcatgaaacagaaatatcaaaaatagaaaataatgctataaaattaaataaattaaataataaaacttaaattcgttctatataagatatagtcctaacaatatggtaacatattgagtattatatatacataataatatatatataatcaaaataatgatatattttaattatacctggattcggtataattagtcatgcagtttctgcaatcgcatctaaaccagtatttggtgtacaaggaatgatttacgctatgtgatctattggattattaggattctgtgtttgaagtcaagatggctttccttataagtaattataaggtaataaatttcactatatgctggaaagatattatatattttaactactaattaatattattaatagtcacaatgttaaaatctttatccaatcagcaagtaacttctttatgaaggaacttcagagactatacgtgaaaatacttatagattaatatatataaaaatattaattaagaaattaatatacatttattaatttttatataaaaactagttcatatatattatgcatctatgtcaacaaattataaatattaatgataataattcaaaattaaaaattatgcctttagataaaggtaaatatggattatttagaaaacattataaaattttattaaaaaaagattttatagaatctgatcaatgattagattgatttgtaggtttttctgagggtgatgattgtttatttacatcagtaaaaaacaatagatgttattttatactaacacaaaaagagataagtatattaaatcatattaaagacgtatttgattttggtaatgtaaaattatttaattataacaataaaagtgttaaaactaaaacagatattatagattttggtagatgaacatgttatgataaaaaattaatagtattattatacttaatttttaatggtaatttatatttaaaatctaaaaatactgatctaaataattgatataatattcttatgaattcacctttatctagattaaaagctgtaggtattacttcattaaatttaatacctatatttaatcctaaattaaataaacctaaattatataattctttattatcaggttttatagatgctgaaggttgttttactatatcattttatactagtgaaaaggtagctgtaagatttatattagatcaagcagaagaagaaatattattaaataatataggtatattatttagtaataaaccttcagtatatttaagaaaaactaaaggaaaggatatttatagataatctatagattgtaatccaaattgagatagatatgataatattatcaactattttgaaacctttcctttaaaatcaaataaactaaataattatatttattgatctcaagttaaagatgtttatttaatgaataaagataaagactttatattaaagattaaacctattatcttagcattaaaagattctgataaatagttatttatattgtaaagtataagatagagtcctttttttatacaggtttatattttaatgttttattatttatttcacctgtataaaatattacatcacatgtttgccgtaggtttagattcagatactagagcttacttcacatcagctacaatggttattgctgtaccaacatctattaaaatcttctcttgattagcaactctttacggaggtacaatcagattaaacgtaactgcattatttgctttaggtttcatcttcttattcacaataggtggattaacaggagttgtattagctaactcagcattagatatcccattccacgatagaaaattaaataaaagatttagttctcaaaaaactcccctaaaggatccctctctcttaaatattaaaaatgatttagaaagaggggctaataatatcttacctttttttgttggtttatttgatggagatggtaatatacaagttaatcattgaagaaagaaaaatcttcaatttagattagttatagaacttcttaataatattggaaatgttagaatgttaaacttaattactaaagaattaggtggtaaaataatattttcaggtataaaagtaaaatgaacaatgaatgatgctcaagaaattataaaactttgtaatatttttaaagagtatcctttattaactaaaaaaaaaagatatcaattagctttcttacaaactttctattctatatataaaaatattgataaagaattagctatgaaattatattttgaattaagaaataataaatatgatagcaatacttataaatatttaaataataaaacgggttgtaataataattatatacctattaattataataaaattgatcaagtttatttttgtaattgatttgctggctttattgaatctgaaggtagcttcagtttaagagtttcaaataatcactcattctcattttctcaaaaagattatgaattaatgttatattgtaaaacattttttaatatacctaataaaattagagatataggaaataatagttatttattagaatgttataaaaaagaacttttagataaatttactatattctttaataaatatccattatatggaaataaattagatcaatttatagaatttaaaaatgcaagagataaaactaacttttgtcctccctcagaggacaaataaatatgtgtcgtgttgtcaaaccactatgttaattatatatataaaagatgaataattaacggttatcccctccccccccatccattataaatggatgggggaggggaaagctaacggtgaaatcttattaatgatagattaatgacctatctactacataattaataagacaataccgtggtaaccaatatatatatgttatattgggaactgtagagactatacgtggttattattataaggttcaataaaaacaaatatattaatttggtcgtataatattaagatatagtccgatccatatcgtgagatatgaaatagaataaatcaaatatatatgttctatttagacttttgtcatactatgtagtagctcaaatgggcctttaactttaattagttaatgcattcagctatatgctggaaactatgtatataaaatatagtttactcggtatttaatatcagtaataataactatatataagaataatatatattattcatacatacaatcagcaggaaactttataggttcctcagagactaaacgctgaatatttaattataataattaaataatgatatagtccgaataataaataatatatttattattattgcatttccactatgtattatcaatgggagcagtattctcaatcttctgtggttgatacttatgatcacctaaaatcttaggattacactataacgagagattaagtcatattcacttctgattaatgttcattggagttaatgttacattcttccctatgcacttcttaggtcaaatgtaggccttatataatagtgatattatattaataacaacactatatgctggaaagtttaaaataacaattacttatagtaaaaatattgttaattatattatattatatatataatattttataatactaatcagcaagtaactttcaataaaaggaacttcagagactacatgtgttgcactcaaaattttgagttgaagatatagtcccccttacatcttaagtgttaaatataacactattattagtaatatactctatattattaaatattcttatattaattataattaatataccttatttattcttttcaagttcctcattaaataattattataataattataattattattcaaataaaggtgaggataatgataaaaataaaaataaaaataaatttaaaatctaaacctgtatctggagtttataatttagatactgagaaacatatacttattaatcaattaaaaaaaaaaaagagccggtgtttatttattacaaagtaatatagatactagttaatatgtaagttcaagttcaaatttagcagttagaattaatacatatttacaatctttaagatgaaatgataatagattaataactaatactatattattacataattttgatttttctattgttatattatcagatataggttatactgataatattactaaagaagaaatattatcaatagagtaaaagtatatagatttatatcaacctaaattaaatttacaacttataactgattctaatttaggttttaaacatagtaaatatactaaataattaatatctcagataataaaagatgaaaagttatcaaatgaaattaaagctaaattaatatttttatttactgataatattaataaaacatttgaaactcaacaattcgaaatatttaataaaattagtgaaattatagattataataaatatcctaattatgctaataaatcaaaagcatttatttatcatatgtttaagaataaaaagggtgttaataatctaatatatgatataaaaaagagccaggaaactttattaaaaataagaaaaccaatatatatttataatagtaataaagaattaatatattcttttgaaaaaactatagatgcagctattaaaaataggagcttctactttaaataaatataaagatactggtataatatataaagatatatatatatatattctaaaaaattagagtaattaataacatatattatatattatatattatatatattatatatattacttatattggatgtaaaagctacaaggaatgccaagaagaattaatgattatccagatgctttcatcggttgaaaccaagtagcatcattaggatcaatcatatctatcgtagcttcaatagtatttatctatgtagtatatgaccaattaacaaatggattacaccaaggaaataaagcattagacagtcaatttaaaccaagctttatgggaactaacttaaatgtagaaggatatacaggaccaacattagagtgaacagtatcaacaccaccttcattacatgcatttaatactccagctgtattatactagtttatataactaaaaaataaaaatgaaaattagttttaataattattattaatttaatcttttacttcgactttttcaagggtaactccctgaaattgaaagattaattgataatttatatacctgtatatacaggttataataatattatgataaattaataatatattatccctatattaatatatatatattaatttaagggtaatattgtatatatacatatcattatcagtttaaccccccccctctctctaaccttttttagggagtgaataaagggataagggactgataaatatttatatatataaatattatataatttaataattatatgatttaatgtatagagaaaataatttataattaatatattaattagtcacggtattatgttaattaatttataatatcaggacataaattatttatagacttttttatagtaaacactttaatatgcctcaattagtacctttttacttcactaatcaaatattttatggtttcgcttcattaagcgtaattgtatacttattttcaatatatatcttaccacactatctagagatatatgttacaagaatatttattactaaaacataatttatttatcagctctaattccttttactttcaaaccgtaaaggatactaatttaatttagtgggctaaaatcaggggttaaccctgattaattatatattttaataaaaaaaaatatatataattatataaacatattaactgtttattataatttaaatttaaacatatcatattgattgtttattaatgtatagagaatacctaacaaatatttattaattataccatttaaggtaaatattaatatatatgtctatctctcctcctgactcccccccccctactagttaacctgtacccttaagcatttttttggaagggtaaatggtaaatggtaaattaattaaattaaattaaattaaattaaattaaattaaattaaattaaattaattttagggtaaagggaatatataaggatgagacttattcaggttagagtatatagactttaaattataacaaataaaaatgaattttatcatcaactcaccattagaacaatttacaactagagtttacttcggtttaagctcaggtttaattaacttagatactataacattaacaagttttagtatatactcaattgctgtagtagcattaatattaggattctcaatcttaaatgataacaatacaaacattttacctacaagatgatcattagcttttgaaagtttatactttacagtagagaaaatggtatcagagcaaataggaggtttagagggaagattattattcccattcatgttttcattattcatgtatattttaatagctaatgttgttagtttagttccatatagttatgctattaacgctcaattaatatgaacaataggtttatcagttgctatctgaatcggatgtactttaactggtttagctaaccatggagctaaattctttggtttattcttaccttcaggtactaatttaccattagttccagtattagtaataattgaattattatcttatatagctagagccttatcattaggtttaagattaggatcaaatatcttagctggtcacttattattagtaatcttagcaggtttaattttaaacttcatctcaattagtatatttacatttgctttaggtatcttacctttatctatcttattaggtatcgtagctttagagtctgcaatcgcatttatccaagctatagtatttacaatattaacatgttcatatattaaagatgctatccacttacactaatgatattatatatataaaataatatctaaaaaatatatatatatttttatttaattattagtatttaattaatcaaacctaaatcttccaatttctaaattggagggtttaggttctgggataatatattaataatcataagtatatcttatcttaatagttttactatttatatataattatctcaactatttgagataagtaattagtagatttatttcaccataatctctcatttataggggtgattatggtcaaagatatataaaaaacaaaacaaaacaaaaaacaaaaaacaaaatgaatttaactttaaaaaaattccaagttcacccattccatttagtagcaccatcaccatgacctattttagtttcattcagtgtgatgtcaattatgttaacattagtatttaatatgcatggtttcatgcataataattattgagtagtattctcagctatagtagctataatgactatggctttatgatttagagatataatctctgaagctacttatttaggagatcatactttagctgtaagaaaaggattaaatataggatttatcttattcgtagtttcagagttattcttcttcatagctatattctgagctttcttccattcagctatggctcctacaattgaattaggaggtgtatgacctccagtaggaatagaagctataggaccttcagaattacctttacttaatactatattattattatgttcaggtgtttgcctgaaatgtattaatttaaagttaatagggaatataaaagataacagtgttttgttttttctctaaacctagagtaccatctttattaagaataggaccacataatcatgatatattatcaatattaataggttcgttattaggtgatggtagtatggaaaaagatggtaatggttcaagatttgcattttatcaagaaaaatcaaatggtgaatatttattacatcttcaccatataattagttctctaggttattgtaaaccggaaatacctaaaatacatacaagaaaaggagcaaaagaaggaacaataagatatatctatagattaagatcttatactttctcttcttttaattgaattcatagtagtttctatcctaataatagaaaagttatacctactaatattaatttagaagattatatcacaccattagctcttgcaatttgagttatggatgatggttattatcataaaaataaaggtataagtttctcaactaattcttttacactagatgaaataaaatatctaggaaatatattaaaaagtaaatactctttagattattctatagtaaaaactgggactattaatcaatataatatatatataccaaaagaatcagcaattttattaggtaagattatcaaaaaacacttagcaccttcaatgtattataaaattccagttcaatgttttttataaattattaacttaaattattatatagtctgcaataatattattaaatattaaattattaacgcaggcaacgtcgatgaaaacggtcaacgattaattttaagaccgtcggttatatttttaaataatatgatcgctacagactggtccatcgatgggtgttatttatataacgctttatgtacagtcggaattctaatagtatttaacttcatattattctaagtacttatatatattttctaacctatatcaaatatcgatatataaattgaaatataatatatatatataagaaacaagggttaatttaattaatcgaggatttggccacattaacatgaagtcatcatgctttattaggaggtaatagatttaatacattattaggtttaatattaactatagctttagctgtaacattcatgatatgtcaatatatggagtatagtaatgctcctttcactatttcagatggtatctttggttctgtattctattttgggacaggtttccatggtttacatattattataggtattatcatgttaggtgtatcattatgaagaatatatacataccaattaacaaataaccaccatgtaggttatgagacatcaatattatattatcactttgttgatgtagtttgattattcctttacatcgttttctattgatgaggaacataaattataaaaatgtttttaacttcaatattattaagttctttatacttgtttaatagaatacttgcatgacaaggtaatgttaaacatttttacttattcgcttcaaacttattattattatttatagttgtattatatattaattttaatactttttcaaatagtttccaatttaattttgaattatttaattcattaaacccttttggtttaagtaattcagatattagtaatggtttattatttggtattgatggtttatcattaactttcatattattaactgtattattaataccattaactttattaggtaattgatataatattaactttaattctaatttatattatactttagtcttagctattggtttagttattttattaaacttctgagctttagattatattagtttctatatattatttgaagctactttacccttattattcattttaatacatatttatggttcttcagattctgaaagagcttctttctatgttttaatgtttactcttagtggttctttattcatgctattatctatcgtagttattagtatcgtattaaatactactaactttattaatcataatttattcgttttatctttagatttacaaactattatttgattaggtctatttatagctataatggtaaaaacacctttattcccaattcatgtatgattaccagttgtacactcagaatctcctttagctggttctatgatcttagctggtttaattttaaaattagctttatacgcaatattaagattattattacctctattatgtgaagcacaaatattatatacacctatgatatatattattagtttattaactattatattgacatctttagctactttaagacaaattgatcttaaagttattatcgcttatagttctatctcacatatgggtatagctatattaggtgtatgttcaaatacttctttaggtatttatggttcaatagtattaggtgtagcacacggttttgtaagtccagctttattcttaatcgttggtggtatattatatgatagatatcatataagaatcgttaactattataaaggattaactacttatatgcctcaattagctacttatattatcatattaagtttcgctaatattggtactccattaacaggtaactttactggtgaattcttatctttacaaggtggttttattagaaatcctattataggtggtattagttgtatatctgttctattggcagctatatatcaattaaaactaactaataaattaactggaggtatttcatctatatatatgcatagaacaaatgatgtaactataagagagaaatttattatgaatatcttaataatttcaactttaattataggtatctgtccacaaattatgtataacttattatattgaactgtaaataattatatttatattatttaaattttaatttatttttatctcttaaattacaaattaatagttttaatttaaattcaatgagacttttaattgtaatcatattagattacctgcccgcttataagcgggccgatatttatatatataaaattataattttatattattatatttttctcctccttcacttctatattatatatatctataaaaagagcatagttaaatggtataacaattgatttcagtccaatcattataggttcgattcctattgctcttgaaagaagtaatttatataatgtatatactatatatctatataaattatataagataatgtttgaacatataaaatctaaccatccctccctataattaaatattaataatttttaattagtgataatggtggaatttggtagacacgcttagtttaggtctaagtctttcgagattgcaagttcaagtcttgcttatcatataaaataaaaatattataattattagtttccctctcctattatccaccataatttacttacccatgattgaaagattataagataaaaggtttataatgggttaaataaaagataaataaagaaaagaaaaaaaaaatacagatgatggtctaatggtatgacgcgtggtttggggctatgcaatcctagttcgattctaggtcatctgataattaagtataatatgtctatacttaatacataatagatttttgaaactagtacatagaaatataattaaatatgcaattagtattagcaggtaaatatatcggagctggattagcttcaatcggattagtaggagccggaatcggaatcgctatcgttttcgcagcattaatcaatggtgtaagtagaaacccagccttaaaaggacaattattcacttactcaatcttaggtttcgctttatcagaggcaacaggattattcgctttaatgatcgctttcttattattatacgctgtataattttagaaacttgaaatcaaagtccaataaattaaaaatatagatagttatatctatatatgaatatatatggtatatataagagttcaaatctcttaatattcattagaaaagtaaaaagatttaatatttaatctaaacttaaaaatatatttatatatattatattattaaataaaagatctaatatttaatctaaacttaaaaatatatttatatatattatatagatatatttataaattatattatatgaatataatatataataatacttataaatattaagttaataatagtttaattgtaaacaatataaataaaaatataaatataattatataaatataattatatttatatataaatctttataatagatattatacatataatgtgtaatatttattcagatagcatacttatataagacattttacatataaagttttaagtatgattatacattaataataataaaaagtttatagatgaatattctttattaataataaatttaatttatgtttaaaatatttaatgatgttccagtgccatatggattatatttccaagattcggcaactcctactttcgatggtataatcgaattacatgatattgttatgttctatatagtagtaacaattgtattagtatcatacttattatttgttataattaaaaatttcagtaatgatcatattagttataaatatttaacacacggtacaactttagaaatagtttgaactatattcccagttgttatcttattatttatagcattcccttcatttatcttattatacttatgtgatgaagttattgacccagctatgactattaaagctatagcttctcaatgatattgaacatatgaatatagtgatttcattggtgaaactggtgaaatagtacaattcgattcgtatatcgtacctacagatatgttagagaatggtcaattaagaatgttagatgtagatgctagaatagtagtacctacaaatacacatttaagatttatcgtgacatctagagatgttatacacgattttgcattacctagtttaggtattaaatgtgatgcaactcctggtagattaaatcaagtatcagctttattacaaagagagtcagtatactatggacaatgttcagaattatgtggtgtattacatagtagtatgcctattgcattagaagctgtatctatagataaattcttatcatgattagacgagcaataaaataaattaaacaagattaataaaaatctaaacctaacgccccccctccccccttaatttacttttttagctttccccctcctaaccctttaataagttaggggggggggggtaataataaaaaagtaataataattaattaaggtgtataataataatatatatatattatatatattattgctacagtgtagataataaaaaagattcgaaatatgtataaatagattgataattaaaagtacaattcacaaaaaatgtttataggaactattatattagttttaagctttttaggattcgtctttaatagaagaaatataatattagcatttatatgtttagagacaatgttgctaggtataaatttaatattattaagaaacagtgtattatttgatgatatctcaggaagtttatttgcaatagtaattataatcttagcaggtgtagagtcagctataggtttatcattattagtaagttattatagattaagaggagttattaatagttatggtatataaatgtataacgctatatcattaattataatactaccttgtataagttgattattcccattattctttggaagacaattagggtatgtatttgtaacaagaatgacaagtacattaataataattacaactttaattacatattattatttttatcaattattaggtaataataatccaataaatttagaattatttaattatttaaatatagactatttagatattaactataattttgaaattgatgctttaactattactatgttattagctattactacaattagtagtatggttcatatatattctataggttatatggaaacagatcctcatcaagtaagatttttctcattattaagtatgttcactttctgaatgataatcttagttacaggttcaaattactttgttttatttgtaggttgagaatttataggtgtaactagttatttattaattagtttctgagttactagattacaagctatgaaatcagcattatctgcagtattaatgaatagatttggtgatgcattcttcgtattaggattatgtgttatagcttatgtatttggaacattaaattattcaactatatttgcaactgcttatttaataaatacagatttattagttttaatcatgttagctttatttatagcagctatggctaaaagtgctcaatttggtttacataattgattgacattagctatggagggttggaataatagggccctcttaaaatttcactatatacgagaatatccccaactagttttaatcattataaatggcttaagacttataaaattattatggtccactcatttaaaattagtgttcggaataattcataatatgggacaattcgtaggcaactgtacttatttattaaaatttacaaatactaatttaataaaaaatataggagcttcagagactacatgtgaaacattattaactaataacttaacaaataatataatagatgataaatttaaacattgattaataggtttcaccgaaggtgatggttcctttatagtatctaatagaggttattgtgaatttaaattaacacaatcaagtatagactctcaagtattatataaaataaaaaatgaattaggtttaggtcatgttgcagttcaagataaaaacaattcaactcatcatttaagaattagagataaagtaggtaataaaaaaattatagatatatttaatggaaatttacatacagaagccaaaattaaacaatttaaatactttttaaattgttataataaagcatatggaattaatattgaatatattgaaaataataaacctgttactttaaataacggttgattatctggttttacagatgctgaaggttgttttaatgcatatatttctaaagaaaaccttaataaaaagaatagaagtgtccaaattagatatattttatctcaaaaaggtgataaaatattaatggataacatagcaaatttattaggtggaagtgtatcacatttaaaagcatataatggttataatatgactgtaaatttaactaaacttaaacctataattgaatattttaatgagtatactttattaactaaaaaaactattagttataatatatgattaaaaatgtattatataactataaataaagaacatattacaagtagtactacagatggtactatagatttaaataaattattagctttaaaagaagaattaactaaagctaataaaataaaataaaccaatttaaaaattaatcaataaataaattaaacacccccccccattcatttttaatgggggggggggactattatattatttgtattattaagttaatatgaagatatagtccgaacaatatagtaatatattgagtatatatatattatattatatatatatcaacattttgccaacaccagtatcatcattattacatgcagctacattagttacagctggtatttatttattattaagatctgctaatatacttgagtatactcctacagtattatttattatattatggataggtgccttaactacattaagtgcaggtcttatagcgatatgttctaatgatttaaaaagaataatagcattatctacaatgagtcaattggctcgaaagaatctaattatgattcttaggaagcaatctatatgcgtagaatttattatcagtccgataataaacaattcgcaggtaaccaaagctctttattatatatataaatataaatataataataataataattacttttttaattcatatttcgcgttgcgacttcttaaagaagaactatgaaaagtaaatattatcagtcagttagtaggaacctcagaggccatacgattgctatctaacatatatactaatattaataagagatatataagtataaaacactttattataaatagattattatttataaacatatctatcttaaccaaaagaattagggtatacactaaaaataaaaaaaaatcatcatataataattataaatatgattctatcttaacaaaatcatctaataattttttaatcaatagagtaggtattagacataattctaatataattaaatctaaagatattaatattgaattaaaacctattaaaaaagatttagttgaacataagaaatttgttcaatgattagctggtttaatagatggtgatggacactttaataaaagtaaacaaggtagatcagctttattaataacaatggatataagagatcaaggtttattatttgagattaaacataaatatggaggtcatattagaaaaattgcaggtgctaatgcagttagatatgatctaagacaagataaaggattaataaacttattaaaggatgtaaatggtttaataagaaatcctaagagacttttacaaatgaatatattgtgtaaacactataatattgagactaaatttagtaaaccattaacttattatgatggttgattagctggtataatagatagtgatggttcaatatattttaataaaagttcaggtcaattatttataagtgtatctcaaaaagaaaaacatatcttagatcctttaatatcaatatatggtggtagaatagattttagtaattctaaaaaagattcatataaatatataatatatagaaagaaagaagtattaaatttattagataattattttaaacattatcaactaagatcagctaaagatattagaataaaaatgatacctaaattatatgaattatatatttatagaaacaaacctgaagaggtagtgaaatatgcagagtgaatttcatttttagataaatgaaataaaatcgttagataaagaaatggtccacataacatttatttatatattttaatttatattattatatatataatgttatttcgcaacttggtatgatgactatcgctataggtttatctgcatataacttagctttattccatttattaggtcatgctttctttaaagcattactatttatgagtgcaggttctataattcatagtattttaaatgaaagtcaagatattagaacttatggaggtttattaagttatttaccatatacatatatttgtatcacaatagcttcattatcattaatggctatgccaggtttaacaggatattatactaaagatattattattgaatctacttatggttcatatagtatctcaaattatgttgtttattgaattgcttatctaagtgctgtattaacatgtgtatattctatgaaaatattatatttaacattctattcaaatcctaataataatactataacatattataatgcacatgagtcaaatatatatattacattacctatgtttatattagctatatttgctatgtttgcaggttgaatattgaaagatatatatctaggtgtaggtacagattttgtaggtacacatatattacctaataatttctcatattttgatacagaattctctataactcaattctataaattactacctttaattagtgctatattagtatcaatattaatagtagtattaaacgaattctttgctatagtatttaatttaaataataaatatattaacactgtatattctatatttaatcaaaaacttgtttctgatcaaatattaaaccactttataatatttaaaggtttagtaacatcaggtaatattgctcaccatgtagataaaggttctttatacagattaggtccagtaggtattaatagattattaaataaagcatcttataatgtaattaatttatcttcaaatacaagaagttcattaagtatgaactctatgttaatattaattactatagtttcattattattattagtattagttatgaatgttaattttataatagtaatacctgtattaatatctattctttatatattatttagttaaactggaattaaacctgaaataattaatataaaagtatataagtacgtagatgaagctatcataaatctgactagcaatttaaatataaaaattggtaattatgtagatgtatgatgtaatatattacaagtgttaggttatttataacacctctaatttataagatatatattaatccaaaagatatcttatagatcccctcataggagatattccctctatactaatgtcccatccccccaaaatacaactatacctcaactgtaatcatattcccccttcccaataaattctcttttattaaaatcaattattatatatattatatatataatatacctctgttaattatatattaataatagttagggggtatattatatatattaggaatagttgtcataggaaggacgagcctcttgctacgaggtattgcaaaatctgctggttcgaccccagcctattccgtatatatgtagaaaaagcatatatgaaaaaaagaagtcctactagtttaatggtaaaatgtttgtcttctaaacagttgatcgtggttcgaatccatggtgggatataaaattttaaaggaaaggtctaaaacctaataaaaatagaataaaaagaatgagaattctaaattatcaaataaaaattatgataagatataaattaataataaataaaataatgttagtatatattatccttaataaatgtcatataatatggctttaagaaagaaaaatagtcttttaaatatggctaattcatatgttttagattcacctcaaccaagtaatttaaattacttttgaaattttggatctctattagcattatgtttagtaatacaattagcaacaggtattacattagcaatgcattatacatcacatgctagtcttgcttttgactcagtggagcatattatgagagatgttaattttggatgattcattagatatgctcatgcaaatacagcttcattcttctttatatgtatatatgctcacatgggtagaaatatttactatggttcatataaaacacctagagttttaccttgatcaataggagtaataatcttcttattattaatcataacagctttcatgggttatgtattagtatttggtcaaatgtctttatgaggtaaatatatagcctcaaatgtatttatattgatgttaattttaaacgttaatttattatatataatatatgatattatatataatacaatcttaaacctttttaaattatatataaaaaaatcaacaaataatttaattctcaatcatgaacctatattatatagaaaagatgtaactaattacatcggaccattaaatagtgatattattagtataatatatggtacactattaggagatggtaatgctgaaaaaagaacagtagttggtggtactagaataaatatatatcaagaaggttcacataaaagttatttattatatttacattctttatttgctaatttaggttattgtaatactaaaatacctaatatcacaactagattaggtaataaagggaaaattagaaaaataataagattttcaacatgatcttatcattcttttaattttatataccaagcttgatatattaaaactaataaaggttttattaaaatattacctaaaaatatagaatattttttaaatccattatctatggcaatatgaattatggatgatggtaaaaaagtaggtgagggtctaaaaatcgcaactaataattttacatctgaagaagtaaatatattagtttctataataactagaaaatttaatcttaaatgtgttaaacaatctagtggtagtaaaaatcaatatataatttatttttgaaaagaatcaataccagatttatgaaatttagttaaggatcatatagaaccttcaatgaaatataaatttggagatgttatttctaatatataataaaggttcaaattaaaaattcaatataaatatatagttatgtttttagataatattagtaatatgttatactttattagaaatattactgttaataaattatatttattaactataaaacatagcaatacgattgaaaatatgtcaaagacatttagttagatgttaagacactgggcttataaagaagtcccaacagagtggttcaattgtagacatctgaaaagatgtttaatgtgcactcggaatttataataaataattatctatccgggtaatatttattacacaaggtttatactacttaataaataaattaaggacaaaaaatatatattgtatagtaatataatttgtataaatacatgctattaatataactaacaaaccatacataaatctaaaaatagctaaaccccctaagccatttataatagctaacctatatataatggaggggttctactaagggtggaatatgtatgtgttgatataataaaagtatcattatattaatcttaattcttatattaagttaaatacatttaagtatttaaagttaaatttggctacagttatttgtaacttagtatcagctataccttgattaggggaagatattgtacacttcttatgaggtgggtttaatttagaggacccatattataatttatttataatattaaaaatcttgcttattgctggaatatccttcttgttaataaaacatataaatttattatataattatattcatttatatatatatgtatatataaattgaaagaaaaatataattatgaaaattaataaatcaaaattatataaatatataataggaggacaatcagcagctgttaggtattttaatactaaagcggctcagagactaaacgcaagaaatctaataaaaaaaactaataatttagatgaattatataaagcttatattgtaggtttaatagaagccttcccccccctcctgtcataagacaggaggggggagaaggcaatgcaagaagcagatggttgagtatctattagtaaaaaaggtaaatacttaacttatgaagtaggtatagaattacatataagagatattcaattattatataaaattaaacaaattttaggagtaggtattataaaaacatataaaagatctaaaaatcttaatgaaacatatgaatattgtagatataatataagaaataaaaaacatttaaaggatgttatattacctatatttgataaatatcctatgttaactaataaaaaatatgattatatgagatttaaacatcatttaattaatggaactatatattcagaaaatcttgaagattataaaagacctttagagactgaaatttctactgaagctattaataatattttaaatattgattatttaccatattgattaataggttttatagaaggagaaggatcatttagttcttatctaaataaagatcaaagggaatgttcatttgaagtatctcaaacgaatagtaagcttataatagaagccttcccccccctcctgtcataagacaggaggggggagaaggcaacgcaagaagcaataaaagaatatttaaaatttaatgtaaaagtttatactaataaagataacaattcaagagttaaaataactagtgtaaatgatatgaaaatattattaaattttatgaaatataatccagttaaattattaggatataaaagactacaatatatattatttttaaaggaattaagatcaatagaaaaatattcaaaaaatataaaaataccatcaaattattagattcaattattagattatgatatagtccgaacaatatagtaatatattgagaataatatatataaatattatcaacaacatgctcagtaggtaaccctacattacaaagattcttcgcattacattatttaatgccattcgtattagctgtatttgctttattacatttaattgcactacatactgctggttcttcaaacccattaggtattacatctaatgttgataaattatcaatgcatccttattacagttttaaagatcttatcacagtattcgcattcttattaatgtttacattatttgtattcttctcacctgataaattaggtcaaggatggcctactactgttaattatattagttttaattaacatatatttttgtgctatatgctggaaccatatacatatattaaaatatgttaaaatttatagtaaaactatcaacttgatatataatcaagatttaagaataatatattatatatctatatttataatattattctttattgaagtaacatattattatgtcataattatgacactttttattttaaatttaaatttaaatttaaataaaagtaaagtatggaatcagcaggtaacttataccaataaattatatatgatttattataaaaggaacctcagagactacacgcacacaagtaagtactatttttaaaagatgtcttcattcaaaagtattttctaaagatacagatttaactgttcttgatatacataataaacctataagtaaagaatttaaacaatgatttgcgggtttagtagatggggatggttatttatatgttaataaagataataattgtggttttgaaataactatggctacacatgatgaaaaagttcttaaaattattcaaaatacatttggtggtaattttataaccaagatcaggtgtaaaagctataagatatagaacacaaaaattaagtgttgttaaaaacatagtaaattgtttaaatggttatgtttataattcagttagattatctcaattacataatgtatgtttagttttagatataaaaccattaagatcagaaaaaccttcctaaagattcagcttatatttctggtttattagattcagatggaactattaattattattcacataactaaaaataaaaatttaatattgtgaatttccatctctaataaatatttacataatattgactttttagaagagatatttggtggttatattcaatatgataaagcttgaaatggtacatataaatgaaatgctacagcattagctgtacataaagaattatatgactattttaatagattttcacctaaaagtataaaatcaaatagaacatcattaatacaagaatatttaaatttatatcaagcaggatactataaatctacagagcctagagaaataaaaatctgaaaggagtttgtaggtaaatgaaatacaatagtataaaaatagatagaattagtactaaatcagtattaattatttaaaattaaaataaaactaaaataaaccatttaattttaaatttacagaagatatagtccattaattatagtaatatactataatttaagcatccagataattatatccctgcaaatccaatggtaactccagcatcgataaaagaagtcaaatataataaaaataattcaaataaaaatcaaatattaaatctattaaataaaaatattaaagatgaagataaatatattgattctaaatcctttcaacaattagctaatggtttatttcaagctgaaggacatataggtggttattttgaattaaatcaaactagctattttagacctatatgttatatatcagtaaatgctacagatgaatcagtaagattatttagaatattaaataaaaactttgataataagttaaaatatattatttctttaaataagtcaggtttatatcatataagaatacaaactagagattgaaatttaatagttaataaatgaataccttattttagtttagcacatggtgataaattaagaggattaaaatatttattaaaagtatattatattcaatactctaatgataaaaatgatatagacttcaataataaaaaaattaacattaatatataatatagttgacaataatcaaagaaaaatctcattaactgataaaataaaattagttcttaatcattcttatcctgattataatattaataatataaattataatatttataatgattatcttatacatgaattacctaaagaacataatgaaatgagtatacctttcattttaggtttttatttaggggatggtacatttaatattaaaatcagagatgagggtacattactatgatatataggtgtattaagaataagtcaaaagtatacagaagataatgaaaaattatttatattaatatctgattatttaaatacttatgatttagatactataattagaccttttaaagaaggtacagttatagtattaaaagtagaatctaatcaaaatattaagaaattatcaaaattattacatgtatatgaagaattttattttattaaaaaagatcaattatattttatgaataaatcatcaaaattattaggtttagtaaaatattgaaaagaaggcaatatagttttattaaatttaatttcagaatataatctaaactacagagttaaaaatgatacaaaatataaatattatttaaacaaaatagaagaagggtttaaaaatcaaagtgatttatattttttatctaaagtgggtattgaaggttatttagttaaattacctataaaaatcaaacctaaaacaaagtatttttattataaaacttataataaggataaggatttaacattaaaaacagcattagattatagagatagaatgttaaatttatatttaatagaaaatgatttaattaaatcttaaatatttgaattattattattattaattaaaacttcaactgtcgcattttaattaatattaaatgaaaaaaaggtgaattgcaagaaaatctgtgataaatataatattattacagacaatttgcagcgaagcttaattgacatattatatatatttgatatataattatattaataattattatatatataaaaaggttaagaacgtccaacgactaaaaatagatatgttatatgtgaacataatttccacgagcgcctttgcactgtcaaacgatcttgtttgagtgtatgacatagtctgaacaattacgtgagtaattgaagttagagataaagagctttaacgataacaaatttgagttccagagtgatacttattaccattctatgctattttaagagctattcctgataaattaggaggtgttatagcaatggttgcagctatattaatattattaatattacctatagtagatagatctataattagaggtaatgcatttaaaccaatttctaaattattatttggtttctttatatgtaatttcttattattaggagtattaggacaagtacatattgagcctccatttatagtattaggacaaatatgtacaatattctatttctcatatttcttaatattattacctatggtatctacaatagaaaatatattcttctatataggaagtttaagaaaatagataataaattaattaataaattaattaatcaatcataaaaaatgttaattttagcaataattagtcttatcactttcgtgtcaatgtctaagttgtctgacaatagagctattatcagattaattaatatctatctaattttagtattagtattagatagtttcttatatcttttattcttaaataatcaaacttatactgtaatgggtgaattattaatatttaattcatttactttctatatagatatgttaatatattttattatgattgttatatcaagtttatatggttataatttatataataataatttatataaaacattatttgaacctaaaaaagaattaataatattatttttaataaatatattaggtgcattattaatagtacattctaatgattttattacattatttgtagctattgaactacaaagttattctatttatttaataacagctatttataatagttcatataaagcttctaaagcttcaatgttatatttctttatgggaggtatattatcaatattaatagcttattctataaatacatactatagtgttttaaattcttatactttacattcattagatagtcttattataaatacattagatttaaatttaatattaatagctttatcattaggtttattattcaaaataggtatagcaccattacataaatgattaatatctatatatgaaaatacacctatattaataacaatttatattagtttaataccaaaaataagtatattatcatatttagtattatcaaatatttcaataaattcattagtaatctctatattagctatcttaactttattagttggatcagttggtggattattacaaataaaaataaaaagattattagcatttagtggtttaactaatgcaggttatatgatgttattattattattaaataataacgaattctcatatttatactatattactcaatatagtatatctcatttagctatatttatgataataatctttagtatatattatattaattatattaataatcaatataatcctattatatatgtaaatcaattaaaaggtttaatacatgataatgcttatttagtattatctatggctatagtggtattctcatttataggtataccaccattattaggattctttggtaaattaaatatattaatgtcaatattaaataatggatattactttatatcaatagttttaatagttgctagtttaatatctgcattatattatttatacttattaaatgtaagtatacaagataaaaataatatactaataaattcaaatgaaacagtatcttcagttttaagttatatattaagttcattaattatattaataacatttggatttatatataactcattaataatagatatatttaatgtctattttaattaaataaataaataaataaaaaatgaatacatttatcatctttattattttaatacctattgtaggttttgctttattagccgtaaatatattattagcagtatataaaccatataatgaaaaattaggagcatttgaatgtggtttaactagtttcaatcaaactagattagcattcaatgcagctttcattttagtagcaatattattcctaccttttgatttagaaatatcaacattattaccttatgttatgtcaatttatttagtatctaattatggtttcactatagttttattatttttattaatattaattataggtttcgtatatgaaattaatactaatgcattaaaaattaacaaacataataaaccaaacacagattcattaatctataagttataataaatcaaactaaagtttagttacaataactaaaattttataatttgtgtttataattatatatataatatatatatataagctctaataccttttttgccttcttcctcttattagacagtagggacgaaacataatatttaggtaggattatatataataagttcaaatcttatatagagtataatatataaaaaatatagagcattgatgaaaaaaaaaaagttaaattaataatctatatattattataatataaacatattat

SEQ ID NO: 5-68 - skipped (64 entries)

SEQ ID NO: 69 - DNA, 991 bp, Artificial Sequence
  Synthetic construct
ggtctcggtgcacgaagaactgcggtcaggtgacacaactttttccatctcagggtgtgtcgcgtgtgcttcatccaaactttagttggggttcgggttcgcgcgagatgatcacgtgccctgatttggtgtcgtcccccgtcgcgctgcgcacgtgatttatttatttccggtggctgctgtctacgcggggccttctctgcccttctgtttcaaccttcgggcggttctcgtaaccagcagtagcaatccatttcgaaactcaaagagctaaaaacgttaaacctcagcagtcgctcgacgaatgggctgcggttgggaagcccacgaggcctatagccagagcctcgagttgacaggagcccagacgccttttccaacggcaacttttatataaaatggcaatgtattcatgcaattgcggccgtgtcaggttggagacactggaccacactctccattgcttcctgaggagatggatcattgctagtgcatctacgcgcagcaatcccgcaagctcgacaaccgtagatgggctttggtgggccaatcaattacgcaacccgcacgttaaattgtatgaggaaggaaggccacggtacaaagtgggtggtcttcacccagtggttgttggtggcgtcatgcagaccatgcattggggatagcacagggttggggtgtcttgtggactcaatgggtgaaaggagatggaaaagggcggtgaaaagtggtagaatcgaaatccctgacgtcaatttataaagtaaaatgcgtttctgccattttgctcccctccttctttcgcaatcgcctccccaaaagttgtcgtggcagtacacatgcttgcatacaatgaagctaatccggcttgctcagtagttgctatatccaggcatggtgtgaaacccctcaaagtatatataggagcggtgagccccagtctggggtcttttctctccatctcaaaactactttctcacaatgggagacc

SEQ ID NO: 70 - DNA, 4156 bp, Artificial Sequence
  Synthetic construct
ggtctcgaatggacaagaagtactccatcggtttggacattggtactaactctgtcggctgggccgtcatcaccgacgagtacaaggttccctccaagaagttcaaggtccttggcaacaccgaccgacactctatcaagaagaacctgatcggtgctctgctgttcgactctggcgagactgccgaggccacccgactgaagcgaaccgctcgacgccgatacacccgacgaaagaaccgaatctgttacctccaggagatcttcagcaacgagatggctaaggtcgacgactccttcttccaccgactcgaggagtctttcctggtcgaagaggataagaagcacgagcgacaccccatcttcggcaacattgttgatgaggttgcctaccatgagaagtaccccaccatctaccacctccgaaagaagctcgtcgactccactgacaaggctgacctccgactcatctaccttgctctcgcccacatgatcaagttccgaggtcacttcctcattgagggtgatctcaaccccgacaactccgacgttgacaagctgttcatccagctcgtccagacctacaaccagctctttgaggagaaccctatcaacgcttctggtgttgacgccaaggccattctctccgcccgactctctaagtcccgacgactcgagaacctcattgcccagctgcccggcgagaagaagaacggcctcttcggtaacctgattgctctctctcttggtctgacccccaacttcaagtccaactttgacctcgccgaggacgccaagctccagctgtccaaggacacctacgatgacgatctggacaacctcctggcccagatcggtgaccagtacgccgatctcttccttgccgccaagaacctctccgacgccatcctgctctccgacatcctccgagtcaacaccgagattaccaaggctcctctgtctgcctctatgatcaagcgatacgacgagcaccaccaggatctcactcttctcaaggctctcgtccgacagcagctccccgagaagtacaaggagattttctttgaccagtccaagaacggttacgctggctacattgacggtggtgcttcccaggaagagttttacaagttcatcaagcctattctggagaagatggacggtaccgaggagctgctcgtcaagctcaaccgagaggacctccttcgaaagcagcgaaccttcgataacggctccatcccccaccagatccacctgggtgagctccacgccattctccgaagacaagaggacttctaccccttcctaaaggataaccgagagaagatcgagaagattctcaccttccgaatcccctactacgtcggtcccctcgctcgaggtaactcccgatttgcttggatgacccgaaagtccgaggagactatcaccccctggaactttgaagaggtagtcgacaagggtgcctccgcccagtctttcattgagcggatgaccaacttcgataagaacctccccaacgagaaggtccttcccaagcactctctcctctacgagtacttcaccgtctacaacgagctgaccaaggtcaagtacgttaccgagggcatgcgaaagcccgctttcctctctggtgagcagaagaaggccattgtcgacctcctgttcaagactaaccgaaaagtcaccgtcaagcagctcaaggaagactacttcaagaagattgagtgcttcgactccgtcgagatttccggtgtcgaggaccgattcaacgcctccctcggcacctaccacgatcttctgaagatcatcaaggacaaggactttcttgataacgaggagaacgaggacattctcgaggacatcgtcctcaccctcacccttttcgaggatcgagagatgatcgaggagcgactcaagacctacgcccatctcttcgacgacaaggtcatgaagcaactcaagcgacgacgatacactggctggggccgactttcccgaaagctcatcaacggcatccgagacaagcagtctggcaagaccatcctggacttcctgaagtccgacggtttcgccaaccgaaacttcatgcagctcatccacgacgactctcttaccttcaaagaggatatccagaaggcccaggtttctggccagggcgactccctccacgagcacattgccaacctcgccggatcccccgccatcaaaaagggtatcctccagaccgtcaaggttgtcgacgaactcgtgaaggtcatgggccgacacaagcccgagaacatcgttatcgagatggcccgagagaaccagaccacccagaagggtcagaagaactcccgagagcgaatgaagcgaatcgaagagggtatcaaggagctcggttcccagattctcaaggagcaccccgtcgagaacacccagctccagaacgagaaactctacctgtactacctccagaatggccgagacatgtacgttgaccaggagctcgacatcaaccgactctccgactacgacgtcgaccacattgttcctcagtccttcctcaaggacgactccatcgacaacaaggttctgacccgatctgacaagaaccgaggtaagtccgacaacgttccctccgaagaggtcgttaagaagatgaagaactactggcgacagcttctcaacgccaaactgatcacccagcgaaagtttgacaacctcaccaaggccgagcgaggtggtctgtccgagctggacaaggccggcttcattaagcgacagctggtcgagactcgacagatcaccaagcacgtcgcccagatcctcgactcccgaatgaacaccaagtacgacgagaacgacaagctcatccgggaggtcaaggtcatcaccctgaagtctaagcttgtctccgacttccgaaaggacttccagttctacaaggtccgagagatcaacaactaccaccacgcccacgacgcctacctcaacgccgttgttggtaccgccctcatcaagaagtatcccaagctcgagtccgagttcgtttacggcgactacaaggtttacgatgtccgaaagatgattgccaagtccgagcaggagatcggtaaggccaccgccaagtactttttctactccaacatcatgaatttcttcaagaccgagatcactctcgccaacggtgagattcgaaagcgacccctgattgagactaatggtgagactggtgagatcgtctgggataagggccgagacttcgccaccgtccgaaaggtcctgtccatgccccaggtcaacattgtcaagaagaccgaggtccagaccggtggcttctccaaggagtccattctccccaagcgaaactccgacaaactcatcgcccgtaagaaggactgggatccgaagaagtacggtggtttcgattctcccaccgttgcctactccgtcctcgttgttgctaaagtcgagaagggtaagtctaagaaactcaagtccgtgaaggagctactcggtatcaccatcatggagcgatcttcttttgagaagaaccccattgacttcctcgaggccaagggttacaaagaggtcaagaaggacctgattatcaagctgcccaagtactccctctttgagctcgagaacggccgaaagcgaatgctggcttccgctggtgagctgcagaagggcaacgagctcgctctgccctccaagtacgtcaacttcctctacctggcctcccactacgagaagctcaagggctcccccgaggacaacgagcagaagcagctgttcgttgagcagcacaagcactacctcgacgagatcatcgagcagatctccgagttctccaagcgagtcatcctcgctgacgccaaccttgataaggttctctctgcttacaacaagcaccgggacaagcccatccgagagcaggccgagaatatcatccacctcttcactctcaccaacctcggcgctcctgctgccttcaagtacttcgacaccaccattgaccgaaagaggtacacctccaccaaggaagtcctcgacgccaccctgatccaccagtccatcaccggcctctacgaaacccgaatcgacctctcccagctcggcggtgactctcgagccgaccccaagaagaagcgaaaagtctaaaggagacc

SEQ ID NO: 71 - DNA, 321 bp, Artificial Sequence
  Synthetic construct
ggtctcgtaaatatccgaagatcaagagcgaagcaagttgtaagtccaggacatgtttcccgcccacgcgagtgatttataacacctctcttttttgacacccgctcgccttgaaattcatgtcacataaattatagtcaacgacgtttgaataacttgtcttgtagttcgatgatgatcatatgattacattaatagtaattactgtatttgatatatatactaattacaatagtacatattagaacatacaatagttagtgccgtgaagtggcttaaaataccgcgagtcgattacgtaatattattacctcggagacc

SEQ ID NO: 72 - DNA, 3506 bp, Artificial Sequence
  Synthetic construct
tagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgagtgcaaccggcgcaggaacactgccagcgcatcaacaatattttcacctgaatcaggatattcttctaatacctggaacgctgtttttccggggatcgcagtggtgagtaaccatgcatcatcaggagtacggataaaatgcttgatggtcggaagtggcataaattccgtcagccagtttagtctgaccatctcatctgtaacatcattggcaacgctacctttgccatgtttcagaaacaactctggcgcatcgggcttcccatacaagcgatagattgtcgcacctgattgcccgacattatcgcgagcccatttatacccatataaatcagcatccatgttggaatttaatcgcggcctcgacgtttcccgttgaatatggctcatattcttcctttttcaatattattgaagcatttatcagggttattgtctcatgagcggatacatatttgaatgtatttagaaaaataaacaaataggggtcagtgttacaaccaattaaccaattctgaacattatcgcgagcccatttatacctgaatatggctcataacaccccttgtttgcctggcggcagtagcgcggtggtcccacctgaccccatgccgaactcagaagtgaaacgccgtagcgccgatggtagtgtggggactccccatgcgagagtagggaactgccaggcatcaaataaaacgaaaggctcagtcgaaagactgggcctttcgcccgggctaattagggggtgtcgcccttattcgactctatagtgaagttcctattctctagaaagtataggaacttctgaagtggggaagcgacttccaatcgctttgcatatccagtaccacacccacaggcgtttgtgcggagaccggcttactaaaagccagataacagtatgcatatttgcgcgctgatttttgcggtataagaatatatactgatatgtatacccgaagtatgtcaaaaagaggtatgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacaggggctggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtttccgttatcggggaagaagtggctgatctcagccaccgcgaaaatgacatcaaaaacgccattaacctgatgttctggggaatataaggtctcgcctcttgcccatcgaacgtacaagtactcctctgttctctccttcctttgctttaaaatgaagtgaagttcctatactttctagagaataggaacttctatagtgagtcgaataagggcgacacaaaatttattctaaatgcataataaatactgataacatcttatagtttgtattatattttgtattatcgttgacatgtataattttgatatcaaaaactgattttccctttattattttcgagatttattttcttaattctctttaacaaactagaaatattgtatatacaaaaaatcataaataatagatgaatagtttaattataggtgttcatcaatcgaaaaagcaacgtatcttatttaaagtgcgttgcttttttctcatttataaggttaaataattctcatatatcaagcaaagtgacaggcgcccttaaatattctgacaaatgctctttccctaaactccccccataaaaaaacccgccgaagcgggtttttacgttatttgcggattaacgattactcgttatcagaaccgcccagggggcccgagcttaagactggccgtcgttttacaacacagaaagagtttgtagaaacgcaaaaaggccatccgtcaggggccttctgcttagtttgatgcctggcagttccctactctcgccttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtgggctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgacgcgcgcgtaactcacgttaagggattttggtcatgagcttgcgccgtcccgtcaagtcagcgtaatgctctgcttt

SEQ ID NO: 73 - DNA, 8267 bp, Artificial Sequence
  Synthetic construct
tagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgagtgcaaccggcgcaggaacactgccagcgcatcaacaatattttcacctgaatcaggatattcttctaatacctggaacgctgtttttccggggatcgcagtggtgagtaaccatgcatcatcaggagtacggataaaatgcttgatggtcggaagtggcataaattccgtcagccagtttagtctgaccatctcatctgtaacatcattggcaacgctacctttgccatgtttcagaaacaactctggcgcatcgggcttcccatacaagcgatagattgtcgcacctgattgcccgacattatcgcgagcccatttatacccatataaatcagcatccatgttggaatttaatcgcggcctcgacgtttcccgttgaatatggctcatattcttcctttttcaatattattgaagcatttatcagggttattgtctcatgagcggatacatatttgaatgtatttagaaaaataaacaaataggggtcagtgttacaaccaattaaccaattctgaacattatcgcgagcccatttatacctgaatatggctcataacaccccttgtttgcctggcggcagtagcgcggtggtcccacctgaccccatgccgaactcagaagtgaaacgccgtagcgccgatggtagtgtggggactccccatgcgagagtagggaactgccaggcatcaaataaaacgaaaggctcagtcgaaagactgggcctttcgcccgggctaattagggggtgtcgcccttattcgactctatagtgaagttcctattctctagaaagtataggaacttctgaagtggggaagcgacttccaatcgctttgcatatccagtaccacacccacaggcgtttgtgcacgaagaactgcggtcaggtgacacaactttttccatctcagggtgtgtcgcgtgtgcttcatccaaactttagttggggttcgggttcgcgcgagatgatcacgtgccctgatttggtgtcgtcccccgtcgcgctgcgcacgtgatttatttatttccggtggctgctgtctacgcggggccttctctgcccttctgtttcaaccttcgggcggttctcgtaaccagcagtagcaatccatttcgaaactcaaagagctaaaaacgttaaacctcagcagtcgctcgacgaatgggctgcggttgggaagcccacgaggcctatagccagagcctcgagttgacaggagcccagacgccttttccaacggcaacttttatataaaatggcaatgtattcatgcaattgcggccgtgtcaggttggagacactggaccacactctccattgcttcctgaggagatggatcattgctagtgcatctacgcgcagcaatcccgcaagctcgacaaccgtagatgggctttggtgggccaatcaattacgcaacccgcacgttaaattgtatgaggaaggaaggccacggtacaaagtgggtggtcttcacccagtggttgttggtggcgtcatgcagaccatgcattggggatagcacagggttggggtgtcttgtggactcaatgggtgaaaggagatggaaaagggcggtgaaaagtggtagaatcgaaatccctgacgtcaatttataaagtaaaatgcgtttctgccattttgctcccctccttctttcgcaatcgcctccccaaaagttgtcgtggcagtacacatgcttgcatacaatgaagctaatccggcttgctcagtagttgctatatccaggcatggtgtgaaacccctcaaagtatatataggagcggtgagccccagtctggggtcttttctctccatctcaaaactactttctcacaatggacaagaagtactccatcggtttggacattggtactaactctgtcggctgggccgtcatcaccgacgagtacaaggttccctccaagaagttcaaggtccttggcaacaccgaccgacactctatcaagaagaacctgatcggtgctctgctgttcgactctggcgagactgccgaggccacccgactgaagcgaaccgctcgacgccgatacacccgacgaaagaaccgaatctgttacctccaggagatcttcagcaacgagatggctaaggtcgacgactccttcttccaccgactcgaggagtctttcctggtcgaagaggataagaagcacgagcgacaccccatcttcggcaacattgttgatgaggttgcctaccatgagaagtaccccaccatctaccacctccgaaagaagctcgtcgactccactgacaaggctgacctccgactcatctaccttgctctcgcccacatgatcaagttccgaggtcacttcctcattgagggtgatctcaaccccgacaactccgacgttgacaagctgttcatccagctcgtccagacctacaaccagctctttgaggagaaccctatcaacgcttctggtgttgacgccaaggccattctctccgcccgactctctaagtcccgacgactcgagaacctcattgcccagctgcccggcgagaagaagaacggcctcttcggtaacctgattgctctctctcttggtctgacccccaacttcaagtccaactttgacctcgccgaggacgccaagctccagctgtccaaggacacctacgatgacgatctggacaacctcctggcccagatcggtgaccagtacgccgatctcttccttgccgccaagaacctctccgacgccatcctgctctccgacatcctccgagtcaacaccgagattaccaaggctcctctgtctgcctctatgatcaagcgatacgacgagcaccaccaggatctcactcttctcaaggctctcgtccgacagcagctccccgagaagtacaaggagattttctttgaccagtccaagaacggttacgctggctacattgacggtggtgcttcccaggaagagttttacaagttcatcaagcctattctggagaagatggacggtaccgaggagctgctcgtcaagctcaaccgagaggacctccttcgaaagcagcgaaccttcgataacggctccatcccccaccagatccacctgggtgagctccacgccattctccgaagacaagaggacttctaccccttcctaaaggataaccgagagaagatcgagaagattctcaccttccgaatcccctactacgtcggtcccctcgctcgaggtaactcccgatttgcttggatgacccgaaagtccgaggagactatcaccccctggaactttgaagaggtagtcgacaagggtgcctccgcccagtctttcattgagcggatgaccaacttcgataagaacctccccaacgagaaggtccttcccaagcactctctcctctacgagtacttcaccgtctacaacgagctgaccaaggtcaagtacgttaccgagggcatgcgaaagcccgctttcctctctggtgagcagaagaaggccattgtcgacctcctgttcaagactaaccgaaaagtcaccgtcaagcagctcaaggaagactacttcaagaagattgagtgcttcgactccgtcgagatttccggtgtcgaggaccgattcaacgcctccctcggcacctaccacgatcttctgaagatcatcaaggacaaggactttcttgataacgaggagaacgaggacattctcgaggacatcgtcctcaccctcacccttttcgaggatcgagagatgatcgaggagcgactcaagacctacgcccatctcttcgacgacaaggtcatgaagcaactcaagcgacgacgatacactggctggggccgactttcccgaaagctcatcaacggcatccgagacaagcagtctggcaagaccatcctggacttcctgaagtccgacggtttcgccaaccgaaacttcatgcagctcatccacgacgactctcttaccttcaaagaggatatccagaaggcccaggtttctggccagggcgactccctccacgagcacattgccaacctcgccggatcccccgccatcaaaaagggtatcctccagaccgtcaaggttgtcgacgaactcgtgaaggtcatgggccgacacaagcccgagaacatcgttatcgagatggcccgagagaaccagaccacccagaagggtcagaagaactcccgagagcgaatgaagcgaatcgaagagggtatcaaggagctcggttcccagattctcaaggagcaccccgtcgagaacacccagctccagaacgagaaactctacctgtactacctccagaatggccgagacatgtacgttgaccaggagctcgacatcaaccgactctccgactacgacgtcgaccacattgttcctcagtccttcctcaaggacgactccatcgacaacaaggttctgacccgatctgacaagaaccgaggtaagtccgacaacgttccctccgaagaggtcgttaagaagatgaagaactactggcgacagcttctcaacgccaaactgatcacccagcgaaagtttgacaacctcaccaaggccgagcgaggtggtctgtccgagctggacaaggccggcttcattaagcgacagctggtcgagactcgacagatcaccaagcacgtcgcccagatcctcgactcccgaatgaacaccaagtacgacgagaacgacaagctcatccgggaggtcaaggtcatcaccctgaagtctaagcttgtctccgacttccgaaaggacttccagttctacaaggtccgagagatcaacaactaccaccacgcccacgacgcctacctcaacgccgttgttggtaccgccctcatcaagaagtatcccaagctcgagtccgagttcgtttacggcgactacaaggtttacgatgtccgaaagatgattgccaagtccgagcaggagatcggtaaggccaccgccaagtactttttctactccaacatcatgaatttcttcaagaccgagatcactctcgccaacggtgagattcgaaagcgacccctgattgagactaatggtgagactggtgagatcgtctgggataagggccgagacttcgccaccgtccgaaaggtcctgtccatgccccaggtcaacattgtcaagaagaccgaggtccagaccggtggcttctccaaggagtccattctccccaagcgaaactccgacaaactcatcgcccgtaagaaggactgggatccgaagaagtacggtggtttcgattctcccaccgttgcctactccgtcctcgttgttgctaaagtcgagaagggtaagtctaagaaactcaagtccgtgaaggagctactcggtatcaccatcatggagcgatcttcttttgagaagaaccccattgacttcctcgaggccaagggttacaaagaggtcaagaaggacctgattatcaagctgcccaagtactccctctttgagctcgagaacggccgaaagcgaatgctggcttccgctggtgagctgcagaagggcaacgagctcgctctgccctccaagtacgtcaacttcctctacctggcctcccactacgagaagctcaagggctcccccgaggacaacgagcagaagcagctgttcgttgagcagcacaagcactacctcgacgagatcatcgagcagatctccgagttctccaagcgagtcatcctcgctgacgccaaccttgataaggttctctctgcttacaacaagcaccgggacaagcccatccgagagcaggccgagaatatcatccacctcttcactctcaccaacctcggcgctcctgctgccttcaagtacttcgacaccaccattgaccgaaagaggtacacctccaccaaggaagtcctcgacgccaccctgatccaccagtccatcaccggcctctacgaaacccgaatcgacctctcccagctcggcggtgactctcgagccgaccccaagaagaagcgaaaagtctaaatatccgaagatcaagagcgaagcaagttgtaagtccaggacatgtttcccgcccacgcgagtgatttataacacctctcttttttgacacccgctcgccttgaaattcatgtcacataaattatagtcaacgacgtttgaataacttgtcttgtagttcgatgatgatcatatgattacattaatagtaattactgtatttgatatatatactaattacaatagtacatattagaacatacaatagttagtgccgtgaagtggcttaaaataccgcgagtcgattacgtaatattattacctcttgcccatcgaacgtacaagtactcctctgttctctccttcctttgctttaaaatgaagtgaagttcctatactttctagagaataggaacttctatagtgagtcgaataagggcgacacaaaatttattctaaatgcataataaatactgataacatcttatagtttgtattatattttgtattatcgttgacatgtataattttgatatcaaaaactgattttccctttattattttcgagatttattttcttaattctctttaacaaactagaaatattgtatatacaaaaaatcataaataatagatgaatagtttaattataggtgttcatcaatcgaaaaagcaacgtatcttatttaaagtgcgttgcttttttctcatttataaggttaaataattctcatatatcaagcaaagtgacaggcgcccttaaatattctgacaaatgctctttccctaaactccccccataaaaaaacccgccgaagcgggtttttacgttatttgcggattaacgattactcgttatcagaaccgcccagggggcccgagcttaagactggccgtcgttttacaacacagaaagagtttgtagaaacgcaaaaaggccatccgtcaggggccttctgcttagtttgatgcctggcagttccctactctcgccttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtgggctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgacgcgcgcgtaactcacgttaagggattttggtcatgagcttgcgccgtcccgtcaagtcagcgtaatgctctgcttt

SEQ ID NO: 74 - DNA, 1021 bp, Artificial Sequence
  Synthetic construct
ggtctcggtgctactctactgatagcaatagatgcgtcataattggttggcccgctgagcctccacaggatactattgcacataccctggtcatgtgcagatcagctcatttgtggagactctggagtaacttagacgacgcctggttcaattgccgcaatgtgcgcccacgcagataatgtattgaggggtggagcgcctcttggggacttgctgtacttgtacgggatattaaacgcactcagcaagaccatgacgtaaaacacacctactgtacgatacgtactgtaggtattgtactcgtacccggtactacaaatagtacgatactatacggagtgtatttgtaccttgatatacgactggcggagtgaagagaaggagttgaacaagaccagatggggatatcagccccagtgctttgtattacaagtacgagtacttaatagatactgtaaggctattgatacggatggcagtaagtcattgagtaagcaattgtggcccagcatctcccctacgtacttgtaccataccccatggagacaccaatggtctttcacgcacactgtcgtgtgctgtatcgcagaatcgggtgtccaaccaaatgccgttacccccacgtcacagccgatagacagatacaccatcaataccagcaggttgtatcatgcggttggctgaaggtaagctgattggtctaaaaactgtagctgtcctaattcaacgagcgctatttggggccaaccacctcggccaagcggcctttaatctgcgtgccccagaggcgtctaatgaggctctggccgccactgtaggagtgtttctctgtgcgcacacgcagttttgagtttgggcgactttccctttttcccaattgcgtacacacacagctccgagctaagcgctgtccttgaaccttctccctcttttccctctttttctcttccccttcccctcctccacattaaggccaaatcctgaattgcaccaactagtacaacgacaacaatgggagacc

SEQ ID NO: 75 - DNA, 233 bp, Artificial Sequence
  Synthetic construct
ggtctcgaatggcaagactgatgagtccgtgaggacgaaacgagtaagctcgtctcttgcactgaccgatctcagttttagagctagaaatagcaagttaaaataaggctagtccgttatcaacttgaaaaagtggcaccgagtcggtgcttttggccggcatggtcccagcctcctcgctggcgccggctgggcaacatgcttcggcatggcgaatgggactaaaggagacc

SEQ ID NO: 76 - DNA, 321 bp, Artificial Sequence
  Synthetic construct
ggtctcgtaaacttcgagctaatccagtagcttacgttacccaggggcaggtcaactggctagccacgagtctgtcccaggtcgcaatttagtgtaataaacaatatatatattgagtctaaagggaattgtagctattgtgattgtgtgattttcgtcttgctggttcttattgtgtcccattcgtttcatcctgatgaggacccctggaaccggtgttttcttagtctctgcaatcgctagtcttgttgctatgacagttgcgtcgacactattcaggtcatctatcggttattctgatattataatacctcggagacc

SEQ ID NO: 77 - DNA, 3506 bp, Artificial Sequence
  Synthetic construct
tagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgagtgcaaccggcgcaggaacactgccagcgcatcaacaatattttcacctgaatcaggatattcttctaatacctggaacgctgtttttccggggatcgcagtggtgagtaaccatgcatcatcaggagtacggataaaatgcttgatggtcggaagtggcataaattccgtcagccagtttagtctgaccatctcatctgtaacatcattggcaacgctacctttgccatgtttcagaaacaactctggcgcatcgggcttcccatacaagcgatagattgtcgcacctgattgcccgacattatcgcgagcccatttatacccatataaatcagcatccatgttggaatttaatcgcggcctcgacgtttcccgttgaatatggctcatattcttcctttttcaatattattgaagcatttatcagggttattgtctcatgagcggatacatatttgaatgtatttagaaaaataaacaaataggggtcagtgttacaaccaattaaccaattctgaacattatcgcgagcccatttatacctgaatatggctcataacaccccttgtttgcctggcggcagtagcgcggtggtcccacctgaccccatgccgaactcagaagtgaaacgccgtagcgccgatggtagtgtggggactccccatgcgagagtagggaactgccaggcatcaaataaaacgaaaggctcagtcgaaagactgggcctttcgcccgggctaattagggggtgtcgcccttattcgactctatagtgaagttcctattctctagaaagtataggaacttctgaagtggggttgcccatcgaacgtacaagtactcctctgttctctccttcctttgctttgtgcggagaccggcttactaaaagccagataacagtatgcatatttgcgcgctgatttttgcggtataagaatatatactgatatgtatacccgaagtatgtcaaaaagaggtatgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacaggggctggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtttccgttatcggggaagaagtggctgatctcagccaccgcgaaaatgacatcaaaaacgccattaacctgatgttctggggaatataaggtctcgcctccggatcgatgtacacaaccgactgcacccaaacgaacacaaatcttagcaaaaatgaagtgaagttcctatactttctagagaataggaacttctatagtgagtcgaataagggcgacacaaaatttattctaaatgcataataaatactgataacatcttatagtttgtattatattttgtattatcgttgacatgtataattttgatatcaaaaactgattttccctttattattttcgagatttattttcttaattctctttaacaaactagaaatattgtatatacaaaaaatcataaataatagatgaatagtttaattataggtgttcatcaatcgaaaaagcaacgtatcttatttaaagtgcgttgcttttttctcatttataaggttaaataattctcatatatcaagcaaagtgacaggcgcccttaaatattctgacaaatgctctttccctaaactccccccataaaaaaacccgccgaagcgggtttttacgttatttgcggattaacgattactcgttatcagaaccgcccagggggcccgagcttaagactggccgtcgttttacaacacagaaagagtttgtagaaacgcaaaaaggccatccgtcaggggccttctgcttagtttgatgcctggcagttccctactctcgccttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtgggctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgacgcgcgcgtaactcacgttaagggattttggtcatgagcttgcgccgtcccgtcaagtcagcgtaatgctctgcttt

SEQ ID NO: 78 - DNA, 4374 bp, Artificial Sequence
  Synthetic construct
tagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgagtgcaaccggcgcaggaacactgccagcgcatcaacaatattttcacctgaatcaggatattcttctaatacctggaacgctgtttttccggggatcgcagtggtgagtaaccatgcatcatcaggagtacggataaaatgcttgatggtcggaagtggcataaattccgtcagccagtttagtctgaccatctcatctgtaacatcattggcaacgctacctttgccatgtttcagaaacaactctggcgcatcgggcttcccatacaagcgatagattgtcgcacctgattgcccgacattatcgcgagcccatttatacccatataaatcagcatccatgttggaatttaatcgcggcctcgacgtttcccgttgaatatggctcatattcttcctttttcaatattattgaagcatttatcagggttattgtctcatgagcggatacatatttgaatgtatttagaaaaataaacaaataggggtcagtgttacaaccaattaaccaattctgaacattatcgcgagcccatttatacctgaatatggctcataacaccccttgtttgcctggcggcagtagcgcggtggtcccacctgaccccatgccgaactcagaagtgaaacgccgtagcgccgatggtagtgtggggactccccatgcgagagtagggaactgccaggcatcaaataaaacgaaaggctcagtcgaaagactgggcctttcgcccgggctaattagggggtgtcgcccttattcgactctatagtgaagttcctattctctagaaagtataggaacttctgaagtggggttgcccatcgaacgtacaagtactcctctgttctctccttcctttgctttgtgctactctactgatagcaatagatgcgtcataattggttggcccgctgagcctccacaggatactattgcacataccctggtcatgtgcagatcagctcatttgtggagactctggagtaacttagacgacgcctggttcaattgccgcaatgtgcgcccacgcagataatgtattgaggggtggagcgcctcttggggacttgctgtacttgtacgggatattaaacgcactcagcaagaccatgacgtaaaacacacctactgtacgatacgtactgtaggtattgtactcgtacccggtactacaaatagtacgatactatacggagtgtatttgtaccttgatatacgactggcggagtgaagagaaggagttgaacaagaccagatggggatatcagccccagtgctttgtattacaagtacgagtacttaatagatactgtaaggctattgatacggatggcagtaagtcattgagtaagcaattgtggcccagcatctcccctacgtacttgtaccataccccatggagacaccaatggtctttcacgcacactgtcgtgtgctgtatcgcagaatcgggtgtccaaccaaatgccgttacccccacgtcacagccgatagacagatacaccatcaataccagcaggttgtatcatgcggttggctgaaggtaagctgattggtctaaaaactgtagctgtcctaattcaacgagcgctatttggggccaaccacctcggccaagcggcctttaatctgcgtgccccagaggcgtctaatgaggctctggccgccactgtaggagtgtttctctgtgcgcacacgcagttttgagtttgggcgactttccctttttcccaattgcgtacacacacagctccgagctaagcgctgtccttgaaccttctccctcttttccctctttttctcttccccttcccctcctccacattaaggccaaatcctgaattgcaccaactagtacaacgacaacaatggcaagactgatgagtccgtgaggacgaaacgagtaagctcgtctcttgcactgaccgatctcagttttagagctagaaatagcaagttaaaataaggctagtccgttatcaacttgaaaaagtggcaccgagtcggtgcttttggccggcatggtcccagcctcctcgctggcgccggctgggcaacatgcttcggcatggcgaatgggactaaacttcgagctaatccagtagcttacgttacccaggggcaggtcaactggctagccacgagtctgtcccaggtcgcaatttagtgtaataaacaatatatatattgagtctaaagggaattgtagctattgtgattgtgtgattttcgtcttgctggttcttattgtgtcccattcgtttcatcctgatgaggacccctggaaccggtgttttcttagtctctgcaatcgctagtcttgttgctatgacagttgcgtcgacactattcaggtcatctatcggttattctgatattataatacctccggatcgatgtacacaaccgactgcacccaaacgaacacaaatcttagcaaaaatgaagtgaagttcctatactttctagagaataggaacttctatagtgagtcgaataagggcgacacaaaatttattctaaatgcataataaatactgataacatcttatagtttgtattatattttgtattatcgttgacatgtataattttgatatcaaaaactgattttccctttattattttcgagatttattttcttaattctctttaacaaactagaaatattgtatatacaaaaaatcataaataatagatgaatagtttaattataggtgttcatcaatcgaaaaagcaacgtatcttatttaaagtgcgttgcttttttctcatttataaggttaaataattctcatatatcaagcaaagtgacaggcgcccttaaatattctgacaaatgctctttccctaaactccccccataaaaaaacccgccgaagcgggtttttacgttatttgcggattaacgattactcgttatcagaaccgcccagggggcccgagcttaagactggccgtcgttttacaacacagaaagagtttgtagaaacgcaaaaaggccatccgtcaggggccttctgcttagtttgatgcctggcagttccctactctcgccttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtgggctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgacgcgcgcgtaactcacgttaagggattttggtcatgagcttgcgccgtcccgtcaagtcagcgtaatgctctgcttt

SEQ ID NO: 79 - DNA, 76 bp, Artificial Sequence
  Synthetic construct
cattaacctataaaaataggcgtatcacgaggccctttcgtctggccacctaggaagcgacttccaatcgctttgc

SEQ ID NO: 80 - DNA, 21 bp, Artificial Sequence
  Synthetic construct
aaagcaaaggaaggagagaac

SEQ ID NO: 81 - DNA, 20 bp, Artificial Sequence
  Synthetic construct
ttgcccatcgaacgtacaag

SEQ ID NO: 82 - DNA, 73 bp, Artificial Sequence
  Synthetic construct
caaaggagtgtgggaggttaagagaattatcaccggcaaactatctgttatgctaagatttgtgttcgtttgg

SEQ ID NO: 83 - DNA, 8168 bp, Artificial Sequence
  Synthetic construct
actcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctggccacctaggccggccagcgtggcgcgcctaagctttacgtacgacgcgcctcgcgtgcttaattaacagatagtttgccggtgataattctcttaacctcccacactcctttgacataacgatttatgtaacgaaactgaaatttgaccagatattgttgtaaatagaaaatctggcttgtaggtggcaaactagtaacggccgccagtgtgctggaattgaatatttaccgttcgtataatgtatgctatacgaagttataccggtctcgtagtgttcacgttcagttcacggtgagcttaaaactatcttcaagaagagatttgagacctgatttatacttgcagcaatgtttacttcttatcgcgatacacgaatgtgatacggatcaaagtaagcaggactacgataagataacgaatgcggtgcagtccatgtcgattaggtatagatacatttattttgtgttatgttacattttggggggatactgtcctacttgtagtacctacttgtagtggcgcgttaggggcagggcatgctcatgtagagcgcctgccgctcgccgtccgaggcggtgccgtcgtacagggcggtgtccaggccgcagagggtgaaccccatccgccggtacgcgtggatcgccggtgcgttgacgttggtgacctccagccagaggtgcccggcgccccgctcgccggcgaactccgtcgcgagccccatcaacgcgcgcccgaccccgtgcccccggtgctccggggcgacctcgatgtcctcgacggtcagccggcggttccacgccgagtacgagatgaccacgaagcccgccaggtcgccgtcgtccccgtacgcgacgaacgtccgggagtccgggtcgccgtcctccccgtcgtccgattcgtcgtccgattcgtcgtcggggaacaccttggtcaggggcgggtccaccggcacctcccgcagggtgaagccgtccccggtggcggtgacgcggaagacggtgtcggtggtgaaggacccatccagtgcctcgatggcctcggcgtcccccgggacactggtgcggtaccggtaagccgtgtcgtcaagagtggtcatttttgtgtctaggtgtttgtgtttggactgcgatcagtgaagaaaagaagaggaaaaattgtgcaagaaattttgctttcaagacttggctgatgcagcagggtaactctgggacacagacctatgtttgtggttaaactcaatgcacgtggtacgtgcgtggagcgcttacccatccaagggtgtggacatggaaccgacggtccgtggagttgtgtaatgtcattttggcgactcttgaagcaaggctataaaaaaattgtgtggcttgagtcttatcgagctcggtcactacaagagttaatcttcctgtctcaggcagacaggtcaggcagggttacttttgggtgtgctgtaactcactgtatggccgttagtgcgcatagacgttgtacatactggaccgaattgtagcgtgctcaatagggccaataaagctattgtagggatccataacttcgtataatgtatgctatacgaacggtacccgggcaattctgcagatatccatcacactggcggccgctcgagcatgcatctagatggcctccttggccgggtttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattacccgggaatctcggtcgtaatgatttttataatgacgaaaaaaaaaaaattggaaagaaaaccccccccccgcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaattcccccttacacggaggcatcaagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcaggtgggccattctcatgaagaatatcttgaatttattgtcatattactagttggtgtggaagtccatatatcggtgatcaatatagtggttgacatgctggctagtcaacattgagccttttgatcatgcaaatatattacggtattttacaatcaaatatcaaacttaactattgactttataacttatttaggtggtaacattcttataaaaaagaaaaaaattactgcaaaacagtactagcttttaacttgtatcctaggttatctatgctgtctcaccatagagaatattacctatttcagaatgtatgtccatgattcgccgggtaaatacatataatacacaaatctggcttaataaagtctataatatatctcataaagaagtgctaaattggctagtgctatatatttttaagaaaatttcttttgactaagtccatatcgactttgtaaaagttcactttagcatacatatattacacgagccagaaattgtaacttttgcctaaaatcacaaattgcaaaatttaattgcttgcaaaaggtcacatgcttataatcaacttttttaaaaatttaaaatacttttttattttttatttttaaacataaatgaaataatttatttattgtttatgattaccgaaacataaaacctgctcaagaaaaagaaactgttttgtccttggaaaaaaagcactacctaggagcggccaaaatgccgaggctttcatagcttaaactctttacagaaaataggcattatagatcagttcgagttttcttattcttccttccggttttatcgtcacagttttacagtaaataagtatcacctcttagagttaactatgagataagcaagtatcatctcatttcatttacctgaagtcgagtaaacagaaaatccaattgttgatgaacctcaatgacttagaactatctatcggcagatcatataaagaggatttaggtacctagaggactgtacctggagtatatatatatatatatatatattatctcaactatagtccatagaggtttctttcttgaggccttaaactgctaaagaatgatattggtggaatgcaagcaccaatctctcttctttcgtaactgttcatatacttcaaaccaagaatgtaacgggcattgacccatccaaaaccttcagtagctgcccctttaaagtcagcaccttgattaccgtattctgcttcaacacgatgaggatctgttcctcttgtgacatcatatttttcaaccacaataccattataatcgacaaaagcctttgtcatcatgaaaagccatctataagctagcctattcgttacagttaaataaccataagaacggaggccttcccaagcaagaatttgatggggtgcccaaccaaatggatagtcccattgtctaattggtctcgaaatagaaattgggcctcgagaacgctccgtacatgcagctaaacctccaagcatctctaacttgggtagtgctttctccaccattttctgtgcttgctccttcgtggcaagtccagcccataatgcccagaatgtagttgcggattcgtatgacgttctgtgcttgatttttgtgttgtagtcaaagaaaaaccccgactcgtcatcccacatatatttggtaattgatgaggcaacgctaattatcaacatatagattgttatctatctgcatgaacacgaaatctttacttgacgacttgaggctgatggtgtttatgcaaagaaaccactgtgtttaatatgtgtcactgtttgatattactgtcagcgtagaagataatagtaaaagcggttaataagtgtatttgagataagtgtgataaagtttttacagcgaaaagacgataaatacaagaaaatgattacgaggatacggagagaggtatgtacatgtgtatttatatactaagctgccggcggttgtttgcaagaccgagaaaaggctagcaagaatcgggtcattgtagcgtatgcgcctgtgaacattctcttcaacaagtttgattccattgcggtgaaatggtaaaagtcaaccccctgcgatgtatattttcctgtacaatcaatcaaaaagccaaatgatttagcattatctttacatcttgttattttacagattttatgtttagatcttttatgcttgcttttcaaaaggcctgcaggcaagtgcacaaacaatacttaaataaatactactcagtaataacctatttcttagcatttttgacgaaatttgctattttgttagagtcttttacaccatttgtctccacacctccgcttacatcaacaccaataacgccatttaatctaagcgcatcaccaacattttctggcgtcagtccaccagctaacataaaatgtaagctctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcat

SEQ ID NO: 84 - DNA, 601 bp, Artificial Sequence
  Synthetic construct
gttagccttctataaccggaccctgaccgatccagtgattttttcttgcaacactatataaaaccgccctcgccctgcagtttgcccccagaaactacgctctttggcttctccccacacatgtagtctgcgatccatgactcggacctgaggcccacccaatgataacatgaactctaagcccaattagccccacgactcattaaaatatatatcgatttgaccttttgacatttgacagtaccgtcacactcctccattagcaatgtccgccacccctcttgcactgaccgatctctagttccatctccctctcgtggcccgaggcaaggtccgagacctgtacgccgtcaacgacaaccagctgctgtttgtcgccactgatcgaatctccgcctacgatgtcatcatgaccaacggtatccccgagaagggcaagattctgacctctatctccaagttctggttccagctgctggccaaggagattaagaaccatgtggccgaaagcgagaactcccagatcctcgccgctctgcccaaggctgtgcaggacgaccccgagctcgtcgagatgctcaaggatcgatgtctgctcgtc

SEQ ID NO: 85 - DNA, 21 bp, Artificial Sequence
  Synthetic construct
gttagccttctataaccggac

SEQ ID NO: 86 - DNA, 22 bp, Artificial Sequence
  Synthetic construct
gacgagcagacatcgatccttg

SEQ ID NO: 87 - DNA, 1810 bp, Artificial Sequence
  Synthetic construct
acgctttccggcatcttccagaccacagtatatccatccgcctcctgttgctaccgttcgtataatgtatgctatacgaagttatgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaacaatgcccgagctgaccgccacctccgtcgagaagttcctcattgagaagttcgactccgtttccgatctcatgcagctctccgagggtgaggagtcccgagccttctccttcgatgtcggtggtcgaggctacgttctccgagtcaactcttgtgccgacggtttctacaaggaccgatacgtctaccgacactttgcctccgctgctctccccatccccgaggttctcgacattggtgagttctctgagtctctgacctactgcatctcccgacgagcccagggtgtcactctccaggatctccccgagactgagctgcccgctgttctccagcccgttgccgaggctatggatgccattgctgctgccgatctgtcccagacctccggtttcggccccttcggtccccagggtatcggtcagtacaccacctggcgagacttcatctgtgccatcgccgacccccacgtctaccactggcagaccgtcatggacgacactgtctctgcttccgtcgcccaggctctcgacgagctgatgctctgggccgaggactgccccgaggtccgacacctcgtccacgccgactttggctccaacaacgttctcaccgacaacggccgaatcaccgccgtcatcgactggtccgaggccatgttcggtgactcccagtacgaggttgccaacatcttcttctggcgaccctggctcgcctgcatggagcagcagacccgatactttgagcgacgacaccccgagctggccggctctccccgactccgagcctacatgctccgaatcggtcttgaccagctctaccagtctctcgtcgacggtaacttcgacgacgccgcctgggctcagggccgatgcgacgccattgtccgatccggtgctggcaccgtcggccgaacccagatcgcccgacgatctgctgccgtctggaccgacggctgtgtcgaggttctggccgactccggcaaccgacgaccttccacccgaccccgagccaaggagtaaatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctcataacttcgtataatgtatgctatacgaacggtacaacgttgtccaggtttgtatccacgtgtgtccgttccgccaatattccgc

SEQ ID NO: 88 - DNA, 21 bp, Artificial Sequence
  Synthetic construct
acgctttccggcatcttccag

SEQ ID NO: 89 - DNA, 20 bp, Artificial Sequence
  Synthetic construct
gcggaatattggcggaacgg

SEQ ID NO: 90 - DNA, 21 bp, Artificial Sequence
  Synthetic construct
gtagcctgtacaagcactgag

SEQ ID NO: 91 - DNA, 933 bp, Artificial Sequence
  Synthetic construct
atgtccgccacccctcttgcactgaccgatctcaagggccatctccctctcgtggcccgaggcaaggtccgagacctgtacgccgtcaacgacaaccagctgctgtttgtcgccactgatcgaatctccgcctacgatgtcatcatgaccaacggtatccccgagaagggcaagattctgacctctatctccaagttctggttccagctgctggccaaggagattaagaaccatgtggccgaaagcgagaactcccagatcctcgccgctctgcccaaggctgtgcaggacgaccccgagctcgtcgagatgctcaaggatcgatgtctgctcgtcaacaagtacaaaattgtgcccattgaggccattgttcgaggctacatcaccggctctgcctggagcgagtacaagaagtccggaaccgtccatggcatgtccgtggagtctggtctgcaggagtcccaaaagctgccccaggccatctacactccctctaccaaggccgagcagggcgagcacgacgagaacatctcggtggccaaggctgccgagatcatcggagacaagaacctcgccgacgagatcgagaagctgtctgtccagctgtacaccaaggctgccgagtacgccgacaagcacggaatcatcattgccgataccaagttcgagtttggtatcgacgagaacggcaaacttgttctggttgatgaggtcctcacgcccgactcctctcgattctggaacgccaagacctacgaggttggtaagccccaggactcctacgataagcagtacctgcgaaactggcttactaacagcggtctcaagggccaggaggacgttgctatgacccctgaggttgtcatcaagacccgagaaaagtacattgaggcttacgagtccatcactggctgcaaatggtgcacccagtaa

SEQ ID NO: 92 - DNA, 933 bp, Artificial Sequence
  Synthetic construct
atgtccgccacccctcttgcactgaccgatctctagttccatctccctctcgtggcccgaggcaaggtccgagacctgtacgccgtcaacgacaaccagctgctgtttgtcgccactgatcgaatctccgcctacgatgtcatcatgaccaacggtatccccgagaagggcaagattctgacctctatctccaagttctggttccagctgctggccaaggagattaagaaccatgtggccgaaagcgagaactcccagatcctcgccgctctgcccaaggctgtgcaggacgaccccgagctcgtcgagatgctcaaggatcgatgtctgctcgtcaacaagtacaaaattgtgcccattgaggccattgttcgaggctacatcaccggctctgcctggagcgagtacaagaagtccggaaccgtccatggcatgtccgtggagtctggtctgcaggagtcccaaaagctgccccaggccatctacactccctctaccaaggccgagcagggcgagcacgacgagaacatctcggtggccaaggctgccgagatcatcggagacaagaacctcgccgacgagatcgagaagctgtctgtccagctgtacaccaaggctgccgagtacgccgacaagcacggaatcatcattgccgataccaagttcgagtttggtatcgacgagaacggcaaacttgttctggttgatgaggtcctcacgcccgactcctctcgattctggaacgccaagacctacgaggttggtaagccccaggactcctacgataagcagtacctgcgaaactggcttactaacagcggtctcaagggccaggaggacgttgctatgacccctgaggttgtcatcaagacccgagaaaagtacattgaggcttacgagtccatcactggctgcaaatggtgcacccagtaa

SEQ ID NO: 93 - DNA, 22 bp, Artificial Sequence
  Synthetic construct
aagcgacttccaatcgctttgc

SEQ ID NO: 94 - DNA, 23 bp, Artificial Sequence
  Synthetic construct
tgctaagatttgtgttcgtttgg

SEQ ID NO: 95-124 - skipped (30 entries)
